US012565653B2

(12) United States Patent
Castoreno et al.

(10) Patent No.: US 12,565,653 B2
(45) Date of Patent: Mar. 3, 2026

(54) ATAXIN3 (ATXN3) RNAI AGENT COMPOSITIONS AND METHODS OF USE THEREOF

(71) Applicant: ALNYLAM PHARMACEUTICALS, INC., Cambridge, MA (US)

(72) Inventors: Adam Castoreno, Framingham, MA (US); Elane Fishilevich, Rochester, MA (US); Jason A. Gilbert, Hingham, MA (US); Charalambos Kaittanis, Cambridge, MA (US); James D. McIninch, Burlington, MA (US); Stuart Milstein, Arlington, MA (US); Mark K. Schlegel, Lexington, MA (US)

(73) Assignee: ALNYLAM PHARMACEUTICALS, INC., Cambridge, MA (US)

( * ) Notice: Subject to any disclaimer, the term of this patent is extended or adjusted under 35 U.S.C. 154(b) by 911 days.

(21) Appl. No.: 17/778,366

(22) PCT Filed: Nov. 20, 2020

(86) PCT No.: PCT/US2020/061674
§ 371 (c)(1),
(2) Date: May 19, 2022

(87) PCT Pub. No.: WO2021/102373
PCT Pub. Date: May 27, 2021

(65) Prior Publication Data
US 2023/0056569 A1 Feb. 23, 2023

Related U.S. Application Data

(60) Provisional application No. 62/939,437, filed on Nov. 22, 2019.

(51) Int. Cl.
*C12N 15/113* (2010.01)
*A61P 25/28* (2006.01)

(52) U.S. Cl.
CPC .......... *C12N 15/1137* (2013.01); *A61P 25/28* (2018.01); *C12N 2310/14* (2013.01);
(Continued)

(58) Field of Classification Search
CPC ............ C12N 15/1137; C12N 2310/14; C12N 2310/315; C12N 2310/321; C12N 2310/351; C12N 2310/3515; A61P 25/28
See application file for complete search history.

(56) References Cited

U.S. PATENT DOCUMENTS 3,228,831 A 1/1966 Nicholson et al.
3,687,808 A 8/1972 Merigan, Jr. et al.
(Continued)

FOREIGN PATENT DOCUMENTS

WO WO 1988/04924 7/1988
WO WO 1991/16024 10/1991
(Continued)

OTHER PUBLICATIONS

Aigner, "Delivery Systems for the Direct Application of siRNAs to Induce RNA Interference (RNAi) In Vivo," J. Biomed. Biotechnol., 2006, 2006:71659, 15 pp.
(Continued)

*Primary Examiner* — Terra C Gibbs
(74) *Attorney, Agent, or Firm* — Womble Bond Dickinson (US) LLP

(57) ABSTRACT
The disclosure relates to double-stranded ribonucleic acid (dsRNA) agents and compositions targeting the ATXN3 gene, as well as methods of inhibiting expression of an APP gene and methods of treating subjects having an ATXN3-
(Continued)

associated disease or disorder, such as SCA3, using such dsRNA agents and compositions.

20 Claims, 5 Drawing Sheets

Specification includes a Sequence Listing.

(52) U.S. Cl.
CPC .. *C12N 2310/315* (2013.01); *C12N 2310/321* (2013.01); *C12N 2310/3515* (2013.01)

(56) References Cited

U.S. PATENT DOCUMENTS

| | | |
|---|---|---|
| 3,904,682 A | 9/1975 | Fried et al. |
| 4,009,197 A | 2/1977 | Fried et al. |
| 4,469,863 A | 9/1984 | Ts'o et al. |
| 4,476,301 A | 10/1984 | Imbach et al. |
| 4,587,044 A | 5/1986 | Miller et al. |
| 4,605,735 A | 8/1986 | Miyoshi et al. |
| 4,667,025 A | 5/1987 | Miyoshi et al. |
| 4,683,202 A | 7/1987 | Mullis |
| 4,762,779 A | 8/1988 | Snitman |
| 4,789,737 A | 12/1988 | Miyoshi et al. |
| 4,824,941 A | 4/1989 | Gordon et al. |
| 4,828,979 A | 5/1989 | Klevan et al. |
| 4,835,263 A | 5/1989 | Nguyen et al. |
| 4,837,028 A | 6/1989 | Allen |
| 4,845,205 A | 7/1989 | Huynh Dinh et al. |
| 4,876,335 A | 10/1989 | Yamane et al. |
| 4,897,355 A | 1/1990 | Eppstein et al. |
| 4,904,582 A | 2/1990 | Tullis |
| 4,948,882 A | 8/1990 | Ruth |
| 4,958,013 A | 9/1990 | Letsinger |
| 4,981,957 A | 1/1991 | Lebleu et al. |
| 5,023,243 A | 6/1991 | Tullis |
| 5,034,506 A | 7/1991 | Summerton et al. |
| 5,082,830 A | 1/1992 | Brakel et al. |
| 5,109,124 A | 4/1992 | Ramachandran et al. |
| 5,112,963 A | 5/1992 | Pieles et al. |
| 5,118,800 A | 6/1992 | Smith et al. |
| 5,118,802 A | 6/1992 | Smith et al. |
| 5,130,302 A | 7/1992 | Spielvogel et al. |
| 5,134,066 A | 7/1992 | Rogers et al. |
| 5,138,045 A | 8/1992 | Cook et al. |
| 5,166,315 A | 11/1992 | Summerton et al. |
| 5,171,678 A | 12/1992 | Behr et al. |
| 5,175,273 A | 12/1992 | Bischofberger et al. |
| 5,177,195 A | 1/1993 | Gregory et al. |
| 5,185,444 A | 2/1993 | Summerton et al. |
| 5,188,897 A | 2/1993 | Suhadolnik et al. |
| 5,214,134 A | 5/1993 | Weis et al. |
| 5,214,136 A | 5/1993 | Lin et al. |
| 5,216,141 A | 6/1993 | Benner |
| 5,218,105 A | 6/1993 | Cook et al. |
| 5,235,033 A | 8/1993 | Summerton et al. |
| 5,245,022 A | 9/1993 | Weis et al. |
| 5,254,469 A | 10/1993 | Warren, III et al. |
| 5,258,506 A | 11/1993 | Urdea et al. |
| 5,262,536 A | 11/1993 | Hobbs, Jr. |
| 5,264,423 A | 11/1993 | Cohen et al. |
| 5,264,562 A | 11/1993 | Matteucci |
| 5,264,564 A | 11/1993 | Matteucci |
| 5,272,250 A | 12/1993 | Spielvogel et al. |
| 5,276,019 A | 1/1994 | Cohen et al. |
| 5,278,302 A | 1/1994 | Caruthers et al. |
| 5,283,185 A | 2/1994 | Epand et al. |
| 5,286,717 A | 2/1994 | Cohen et al. |
| 5,292,873 A | 3/1994 | Rokita et al. |
| 5,317,098 A | 5/1994 | Shizuya et al. |
| 5,319,080 A | 6/1994 | Leumann |
| 5,321,131 A | 6/1994 | Agrawal et al. |
| 5,359,044 A | 10/1994 | Cook et al. |
| 5,367,066 A | 11/1994 | Urdea et al. |
| 5,371,241 A | 12/1994 | Brush |
| 5,391,723 A | 2/1995 | Priest |
| 5,393,878 A | 2/1995 | Leumann |
| 5,399,676 A | 3/1995 | Froehler |
| 5,405,938 A | 4/1995 | Summerton et al. |
| 5,405,939 A | 4/1995 | Suhadolnik et al. |
| 5,414,077 A | 5/1995 | Lin et al. |
| 5,416,203 A | 5/1995 | Letsinger |
| 5,432,272 A | 7/1995 | Benner |
| 5,434,257 A | 7/1995 | Matteucci et al. |
| 5,445,934 A | 8/1995 | Fodor et al. |
| 5,446,137 A | 8/1995 | Maag et al. |
| 5,451,463 A | 9/1995 | Nelson et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,459,255 A | 10/1995 | Cook et al. |
| 5,466,677 A | 11/1995 | Baxter et al. |
| 5,466,786 A | 11/1995 | Buhr et al. |
| 5,470,967 A | 11/1995 | Huie et al. |
| 5,476,925 A | 12/1995 | Letsinger et al. |
| 5,484,908 A | 1/1996 | Froehler et al. |
| 5,486,603 A | 1/1996 | Buhr |
| 5,489,677 A | 2/1996 | Sanghvi et al. |
| 5,502,177 A | 3/1996 | Matteucci et al. |
| 5,510,475 A | 4/1996 | Agrawal et al. |
| 5,512,439 A | 4/1996 | Hornes et al. |
| 5,512,667 A | 4/1996 | Reed et al. |
| 5,514,785 A | 5/1996 | Van Ness et al. |
| 5,519,126 A | 5/1996 | Hecht |
| 5,519,134 A | 5/1996 | Acevedo et al. |
| 5,525,465 A | 6/1996 | Haralambidis et al. |
| 5,525,711 A | 6/1996 | Hawkins et al. |
| 5,536,821 A | 7/1996 | Agrawal et al. |
| 5,539,082 A | 7/1996 | Nielsen et al. |
| 5,541,307 A | 7/1996 | Cook et al. |
| 5,541,313 A | 7/1996 | Ruth |
| 5,541,316 A | 7/1996 | Engelskirchen et al. |
| 5,543,152 A | 8/1996 | Webb et al. |
| 5,545,730 A | 8/1996 | Urdea et al. |
| 5,550,111 A | 8/1996 | Suhadolnik et al. |
| 5,552,538 A | 9/1996 | Urdea et al. |
| 5,552,540 A | 9/1996 | Haralambidis |
| 5,561,225 A | 10/1996 | Maddry et al. |
| 5,563,253 A | 10/1996 | Agrawal et al. |
| 5,565,552 A | 10/1996 | Magda et al. |
| 5,567,810 A | 10/1996 | Weis et al. |
| 5,567,811 A | 10/1996 | Misiura et al. |
| 5,571,799 A | 11/1996 | Tkachuk et al. |
| 5,574,142 A | 11/1996 | Meyer, Jr. et al. |
| 5,576,427 A | 11/1996 | Cook et al. |
| 5,578,717 A | 11/1996 | Urdea et al. |
| 5,578,718 A | 11/1996 | Cook et al. |
| 5,580,731 A | 12/1996 | Chang et al. |
| 5,585,481 A | 12/1996 | Arnold, Jr. et al. |
| 5,587,361 A | 12/1996 | Cook et al. |
| 5,587,371 A | 12/1996 | Sessler et al. |
| 5,587,469 A | 12/1996 | Cook et al. |
| 5,591,584 A | 1/1997 | Chang et al. |
| 5,591,722 A | 1/1997 | Montgomery et al. |
| 5,594,121 A | 1/1997 | Froehler et al. |
| 5,595,726 A | 1/1997 | Magda et al. |
| 5,596,086 A | 1/1997 | Matteucci et al. |
| 5,596,091 A | 1/1997 | Switzer |
| 5,597,696 A | 1/1997 | Linn et al. |
| 5,597,909 A | 1/1997 | Urdea et al. |
| 5,599,923 A | 2/1997 | Sessler et al. |
| 5,599,928 A | 2/1997 | Hemmi et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bischofberger et al. |
| 5,639,873 A | 6/1997 | Barascut et al. |

(56)                    References Cited

U.S. PATENT DOCUMENTS

| | | | |
|---|---|---|---|
| 5,646,265 | A | 7/1997 | McGee |
| 5,658,873 | A | 8/1997 | Bertsch-Frank et al. |
| 5,663,312 | A | 9/1997 | Chaturvedula |
| 5,670,633 | A | 9/1997 | Cook et al. |
| 5,677,195 | A | 10/1997 | Winkler et al. |
| 5,677,437 | A | 10/1997 | Teng et al. |
| 5,677,439 | A | 10/1997 | Weis et al. |
| 5,681,941 | A | 10/1997 | Cook et al. |
| 5,688,941 | A | 11/1997 | Cook et al. |
| 5,700,920 | A | 12/1997 | Altmann et al. |
| 5,705,188 | A | 1/1998 | Junichi et al. |
| 5,714,331 | A | 2/1998 | Buchardt et al. |
| 5,719,262 | A | 2/1998 | Buchardt et al. |
| 5,744,305 | A | 4/1998 | Fodor et al. |
| 5,750,692 | A | 5/1998 | Cook et al. |
| 5,770,722 | A | 6/1998 | Lockhart et al. |
| 5,854,033 | A | 12/1998 | Lizardi |
| 5,874,219 | A | 2/1999 | Rava et al. |
| 5,976,567 | A | 11/1999 | Wheeler et al. |
| 5,981,501 | A | 11/1999 | Wheeler et al. |
| 6,015,886 | A | 1/2000 | Dale et al. |
| 6,028,188 | A | 2/2000 | Arnold, Jr. et al. |
| 6,054,299 | A | 4/2000 | Conrad |
| 6,124,445 | A | 9/2000 | Imbach et al. |
| 6,147,200 | A | 11/2000 | Manoharan et al. |
| 6,160,109 | A | 12/2000 | Just et al. |
| 6,166,197 | A | 12/2000 | Cook et al. |
| 6,169,170 | B1 | 1/2001 | Gryaznov et al. |
| 6,172,209 | B1 | 1/2001 | Manoharan et al. |
| 6,191,105 | B1 | 2/2001 | Ekwuribe et al. |
| 6,222,025 | B1 | 4/2001 | Cook et al. |
| 6,235,887 | B1 | 5/2001 | Froehler et al. |
| 6,239,265 | B1 | 5/2001 | Cook |
| 6,268,490 | B1 | 7/2001 | Imanishi et al. |
| 6,277,603 | B1 | 8/2001 | Cook |
| 6,294,664 | B1 | 9/2001 | Ravikumar et al. |
| 6,320,017 | B1 | 11/2001 | Ansell |
| 6,326,199 | B1 | 12/2001 | Cook et al. |
| 6,346,614 | B1 | 2/2002 | Metelev et al. |
| 6,380,368 | B1 | 4/2002 | Froehler et al. |
| 6,444,423 | B1 | 9/2002 | Meade et al. |
| 6,525,191 | B1 | 2/2003 | Ramasamy |
| 6,528,640 | B1 | 3/2003 | Beigelman et al. |
| 6,531,590 | B1 | 3/2003 | Manoharan et al. |
| 6,534,484 | B1 | 3/2003 | Wheeler et al. |
| 6,534,639 | B1 | 3/2003 | Manoharan et al. |
| 6,576,752 | B1 | 6/2003 | Manoharan et al. |
| 6,586,410 | B1 | 7/2003 | Wheeler et al. |
| 6,608,035 | B1 | 8/2003 | Agrawal et al. |
| 6,617,438 | B1 | 9/2003 | Beigelman et al. |
| 6,639,062 | B2 | 10/2003 | Manoharan et al. |
| 6,670,461 | B1 | 12/2003 | Wengel et al. |
| 6,683,167 | B2 | 1/2004 | Metelev et al. |
| 6,747,014 | B2 | 6/2004 | Teng et al. |
| 6,770,748 | B2 | 8/2004 | Imanishi et al. |
| 6,783,931 | B1 | 8/2004 | Cook et al. |
| 6,794,499 | B2 | 9/2004 | Wengel et al. |
| 6,815,432 | B2 | 11/2004 | Wheeler et al. |
| 6,858,225 | B2 | 2/2005 | Semple et al. |
| 6,858,715 | B2 | 2/2005 | Ravikumar et al. |
| 6,867,294 | B1 | 3/2005 | Sanghvi et al. |
| 6,878,805 | B2 | 4/2005 | Manoharan et al. |
| 6,887,906 | B1 | 5/2005 | Teng et al. |
| 6,900,297 | B1 | 5/2005 | Cook et al. |
| 6,998,484 | B2 | 2/2006 | Koch et al. |
| 7,015,315 | B1 | 3/2006 | Cook et al. |
| 7,034,133 | B2 | 4/2006 | Wengel et al. |
| 7,037,646 | B1 | 5/2006 | Cook et al. |
| 7,041,816 | B2 | 5/2006 | Ravikumar et al. |
| 7,045,610 | B2 | 5/2006 | Dempcy et al. |
| 7,053,207 | B2 | 5/2006 | Wengel |
| 7,063,860 | B2 | 6/2006 | Chancellor et al. |
| 7,070,802 | B1 | 7/2006 | Bhalani et al. |
| 7,084,125 | B2 | 8/2006 | Wengel |
| RE39,464 | E | 1/2007 | Cook et al. |
| 7,157,099 | B2 | 1/2007 | Autuori et al. |
| 7,273,933 | B1 | 9/2007 | Krotz et al. |
| 7,321,029 | B2 | 1/2008 | Gryaznov et al. |
| 7,399,845 | B2 | 7/2008 | Seth et al. |
| 7,427,605 | B2 | 9/2008 | Davis et al. |
| 7,427,672 | B2 | 9/2008 | Imanishi et al. |
| 7,495,088 | B1 | 2/2009 | Brakel et al. |
| 7,569,686 | B1 | 8/2009 | Bhat et al. |
| 7,626,014 | B2 | 12/2009 | Manoharan et al. |
| 7,741,457 | B2 | 6/2010 | Seth et al. |
| 7,858,769 | B2 | 12/2010 | Jadhav et al. |
| 8,022,193 | B2 | 9/2011 | Seth et al. |
| 8,030,467 | B2 | 10/2011 | Seth et al. |
| 8,058,069 | B2 | 11/2011 | Yaworski et al. |
| 8,101,348 | B2 | 1/2012 | Tuschl et al. |
| 8,106,022 | B2 | 1/2012 | Manoharan et al. |
| 8,158,601 | B2 | 4/2012 | Chen et al. |
| 8,278,283 | B2 | 10/2012 | Seth et al. |
| 8,278,425 | B2 | 10/2012 | Prakash et al. |
| 8,278,426 | B2 | 10/2012 | Seth et al. |
| 8,314,227 | B2 | 11/2012 | Wengel |
| 2003/0027780 | A1 | 2/2003 | Hardee et al. |
| 2004/0171570 | A1 | 9/2004 | Allerson et al. |
| 2004/0241854 | A1 | 12/2004 | Davidson et al. |
| 2005/0244858 | A1 | 11/2005 | Rossi et al. |
| 2008/0039618 | A1 | 2/2008 | Allerson et al. |
| 2009/0012281 | A1 | 1/2009 | Swayze et al. |
| 2009/0253583 | A1* | 10/2009 | Yoganathan ......... C12Q 1/6886 506/7 |
| 2010/0173973 | A1 | 7/2010 | Brown |
| 2010/0324120 | A1 | 12/2010 | Chen et al. |
| 2011/0313020 | A1 | 12/2011 | Templin et al. |
| 2012/0157511 | A1 | 6/2012 | Manoharan et al. |
| 2013/0011922 | A1 | 1/2013 | Quay et al. |
| 2013/0096289 | A1 | 4/2013 | Wengel |
| 2013/0190383 | A1 | 7/2013 | Vaish et al. |

FOREIGN PATENT DOCUMENTS

| | | |
|---|---|---|
| WO | WO 1993/24640 | 12/1993 |
| WO | WO 1994/00569 | 1/1994 |
| WO | WO 1994/02595 | 2/1994 |
| WO | WO 1996/37194 | 11/1996 |
| WO | WO 1996/40964 | 12/1996 |
| WO | WO 1997/13499 | 4/1997 |
| WO | WO 1997/30731 | 8/1997 |
| WO | WO 1998/39359 | 9/1998 |
| WO | WO 1999/14226 | 3/1999 |
| WO | WO 2000/03683 | 1/2000 |
| WO | WO 2000/22114 | 4/2000 |
| WO | WO 2007/091269 | 8/2007 |
| WO | WO 2007/117686 | 10/2007 |
| WO | WO 2008/019159 | 2/2008 |
| WO | WO 2008/042973 | 4/2008 |
| WO | WO 2009/014887 | 1/2009 |
| WO | WO 2009/088891 | 7/2009 |
| WO | WO 2009/088892 | 7/2009 |
| WO | WO 2009/127060 | 10/2009 |
| WO | WO 2009/132131 | 10/2009 |
| WO | WO 2010/011895 | 1/2010 |
| WO | WO 2010/054406 | 5/2010 |
| WO | WO 2010/088537 | 8/2010 |
| WO | WO 2010/129709 | 11/2010 |
| WO | WO 2010/141511 | 12/2010 |
| WO | WO 2011/005861 | 1/2011 |
| WO | WO 2011/031520 | 3/2011 |
| WO | WO 2011/133876 | 10/2011 |
| WO | WO 2012/018881 | 2/2012 |
| WO | WO 2012/177639 | 12/2012 |
| WO | WO 2012/177906 | 12/2012 |
| WO | WO 2013/036868 | 3/2013 |
| WO | WO 2013/075035 | 5/2013 |
| WO | WO 2013/138353 | 9/2013 |
| WO | WO 2014/179620 | 11/2014 |
| WO | WO 2014/179627 | 11/2014 |
| WO | WO 2015/116658 | 8/2015 |
| WO | WO 2019/055633 | 3/2019 |

(56)                    References Cited

FOREIGN PATENT DOCUMENTS

WO      WO 2019/217459      11/2019
WO      WO 2019/217708      11/2019
WO       WO 2000/22113        4/2022

OTHER PUBLICATIONS

Akaneya et al., "RNAi-Induced Gene Silencing by Local Electroporation in Targeting Brain Region," J. Neurophysiol., 2005, 93:594-602.

Akhtar & Juliano, "Cellular uptake and intracellular fate of antisense oligonucleotides," Trends Cell. Biol., 1992, 2(5):139-144.

Allen & Chonn, "Large unilamellar liposomes with low uptake into the reticuloendothelial system," FEBS Letters, 1987, 223(1):42-46.

Aoki et al., "Potential tumor-targeting peptide vector of histidylated oligolysine conjugated to a tumor-homing RGD motif," Cancer Gene Therapy, 2001, 8(10):783-787.

Arnold et al., "Specific beta1-adrenergic receptor silencing with small interfering RNA lowers high blood pressure and improves cardiac function in myocardial ischemia," J. Hypertens., 2007, 25(1):197-205.

Ashizawa et al., "Spinocerebellar ataxias: prospects and challenges for therapy development," Nat. Rev. Neurol., 2018, 14(10):590-605.

Bangham et al., "Diffusion of Univalent Ions Across the Lamellae of Swollen Phospholipids," J. Mol. Biol., 1965, 13:238-252.

Bernstein et al., "Role for a bidentate ribonuclease in the initiation step of RNA interference," Nature, 2001, 409:363-366.

Bettencourt et al., "Machado-Joseph Disease: from first descriptions to new perspectives," Orphanet Journal of Rare Diseases, 2011, 6:35, 12 pp.

Bitko et al., "Inhibition of respiratory viruses by nasally administered siRNA," Nat. Med., 2005, 11:50-55; published online Dec. 26, 2004.

Bonnet et al., "Systemic Delivery of DNA or siRNA Mediated by Linear Polyethylenimine (L-PEI) Does Not Induce an Inflammatory Response," Pharm. Res., 2008, 25(12):2972-2982; Epub Aug. 16, 2008.

Boy et al., "A transgenic mouse model of spinocerebellar ataxia type 3 resembling late disease onset and gender-specific instability of CAG repeats," Neurobiol. Dis., 2010, 37:284-293.

Buur et al., "Penetration of 5-Fluorouracil and Prodrugs Across the Intestine of the Albino Rabbit: Evidence for Shift in Absorption Site from the Upper to the Lower Region of the Gastrointestinal Tract by Prodrugs," J. Control Rel., 1990, 14:43-51.

Cemal et al., "YAC transgenic mice carrying pathological alleles of the MJD1 locus exhibit a mild and slowly progressive cerebellar deficit," Hum. Mol. Gen., 2002, 11(9):1075-1094.

Chien et al., "Novel cationic cardiolipin analogue-based liposome for efficient DNA and small interfering RNA delivery in vitro and in vivo," Cancer Gene Ther., 2005, 12:321-328.

Chu & Rana, "Potent RNAi by short RNA triggers," RNA, 2008, 14:1714-1719.

Constantinides et al., "Formulation and Intestinal Absorption Enhancement Evaluation of Water-in-Oil Microemulsions Incorporating Medium-Chain Glycerides," Pharmaceutical Research, 1994, 11(10):1385-1390.

Couture & Stinchcomb, "Anti-gene therapy: the use of ribozymes to inhibit gene function," Trends in Genetics, 1996, 12(12):510-515.

Crooke et al., "Pharmacokinetic Properties of Several Novel Oligonucleotide Analogs in mice," J. Pharmacol. Exp. Ther., 1996, 277:923-937.

Dorn et al., "siRNA relieves chronic neuropathic pain," Nucleic Acids, 2004, 32:e49, 6 pp.

Doss-Pepe et al., "Ataxin-3 Interactions with Rad23 and Valosin-Containing Protein and Its Associations with Ubiquitin Chains and the Proteasome Are Consistent with a Role in Ubiquitin-Mediated Proteolysis," Mol. Cell Biol., 2003, 23(18):6469-6483.

Du Plessis et al., "Topical delivery of liposomally encapsulated gamma-interferon," Antiviral Research, 1992, 18:259-265.

Elbashir et al., "Functional anatomy of siRNAs for mediating efficient RNAi in *Drosophila melanogaster* embryo lysate," Embo J., 2001, 20(23):6877-6888.

Elbashir et al., "RNA interference is mediated by 21-and 22-nucleotide RNAs," Genes Dev., 2001, 15:188-200.

El-Hariri et al., "The Mitigating Effects of Phosphatidylcholines on Bile Salt- and Lysophosphatidylcholine-induced Membrane Damage," J. Pharm. Pharmacol., 1992, 44:651-654.

Elmén et al., "Locked nucleic acid (LNA) mediated improvements in siRNA stability and functionality," Nucleic Acids Research, 2005, 33(1):439-447.

Felgner et al., "Lipofection: A highly efficient, lipid-mediated DNA-transfection procedure," Proc. Natl. Acad. Sci. USA, 1987, 84:7413-7417.

Felgner et al., "Enhanced Gene Delivery and Mechanism Studies with a Novel Series of Cationic Lipid Formulations," J. Biol. Chem., 1994, 269(4):2550-2561.

Fluiter et al., "Filling the gap in LNA antisense oligo gapmers: the effects of unlocked nucleic acid (UNA) and 4'- C-hydroxymethyl-DNA modifications on RNase H recruitment and efficacy of an LNA gapmer," Mol. Biosyst., 2009, 5:838-843.

Fukunaga et al., "Liposome Entrapment Enhances the Hypocalcemic Action of Parenterally Administered Calcitonin," Endocrinol., 1984, 115(2):757-761.

Gabizon & Papahadjopoulos, "Liposome formulations with prolonged circulation time in blood and enhanced uptake by tumors," Proc. Natl. Acad. Sci. USA, 1988, 85:6949-6953.

Gao et al, "A Novel Cationic Liposome Reagent for Efficient Transfection of Mammalian Cells," Biochim. Biophys. Res. Commun., 1991, 179(1):280-285.

Gassmann et al., "Maintenance of an extrachromosomal plasmid vector in mouse embryonic stem cells," Proc. Natl. Acad. Sci. USA, 1995, 92:1292-1296.

Gershon et al., "Mode of Formation and Structural Features of DNA-Cationic Liposome Complexes Used for Transfection," Biochem., 1993, 32:7143-7151.

Grünweller et al., "Comparison of different antisense strategies in mammalian cells using locked nucleic acids, 2'-O-methyl RNA, phosphorothioates and small interfering RNA," Nucleic Acids Research, 2003, 31(12):3185-3193.

Guatelli et al., "Isothermal, in vitro amplification of nucleic acids by a multienzyme reaction modeled after retroviral replication," Proc. Natl. Acad. Sci. USA, 1990, 87:1874-1878.

Haubner et al., "Glycosylated RGD-Containing Peptides: Tracer for Tumor Targeting and Angiogenesis Imaging with Improved Biokinetics," J Nucl Med, 2001, 42:326-336.

Ho et al., "Preparation of Microemulsions Using Polyglycerol Fatty Acid Esters as Surfactant for the Delivery of Protein Drugs," J. Pharm. Sci., 1996, 85(2):138-143.

Howard et al., "RNA Interference in Vitro and in Vivo Using a Chitosan/siRNA Nanoparticle System," Mol. Ther., 2006, 14(4):476-484.

Hu et al., "Topical delivery of cyclosporin A from non-ionic liposomal systems : an in vivo/in vitro correlation study using hairless mouse skin," S.T.P. Pharma. Sci., 1994, 4(6):466-469.

Itani et al., "A simple and efficient liposome method for transfection of DNA into mammalian cells grown in suspension," Gene, 1987, 56:267-276.

Jarrett, "Affinity chromatography with nucleic acid polymers," Chromatogr., 1993, 618:315-339.

Jensen et al., "Unlocked nucleic acid (UNA) and UNA derivatives: Thermal denaturation studies," Nuc. Acids Symp. Series, 2008, 52(1):133-134.

Kabanov et al., "A new class of antivirals: antisense oligonucleotides combined with a hydrophobic substituent effectively inhibit influenza virus reproduction and synthesis of virus-specific proteins in MDCK cells," FEBS Lett., 1990, 259(2):327-330.

Kim et al., "Preparation of Multivesicular Liposomes," Biochim. Biophys. Acta, 1983, 728:339-348.

Kim et al., "Synthetic dsRNA Dicer substrates enhance RNAi potency and efficacy," Nat Biotech, 2005, 23(2):222-226.

(56)  References Cited

OTHER PUBLICATIONS

Kim et al., "Cholesteryl Oligoarginine Delivering Vascular Endothelial Growth Factor siRNA Effectively Inhibits Tumor Growth in Colon Adenocarcinoma," Mol. Ther., 2006, 14(3):343-350.

Kim et al., "Local and systemic delivery of VEGF siRNA using polyelectrolyte complex micelles for effective treatment of cancer," Journal of Controlled Release, 2008, 129:107-116.

Klockgether et al., "Repeat length and disease progression in spinocerebellar ataxia type 3," The Lancet, 1996, 348:830.

Koeppen, "The Neuropathology of Spinocerebellar Ataxia Type 3/Machado-Joseph Disease," Adv. Exp. Med. Biol., 2018, 1049:233-241.

Kubo et al., "Chemically modified symmetric and asymmetric duplex RNAs: an enhanced stability to nuclease degradation and gene silencing effect," Biochem. Biophys. Res. Comm., 2008, 365:54-61; available online Oct. 29, 2007.

Kwoh et al., "Transcription-based amplification system and detection of amplified human immunodeficiency virus type 1 with a bead-based sandwich hybridization format," Proc. Natl. Acad. Sci. USA, 1989, 86:1173-1177.

Lam et al., "A new type of synthetic peptide library for identifying ligand-binding activity," Nature, 1991, 354:82-84.

Lee et al., "Mucosal Penetration Enhancers for Facilitation of Peptide and Protein Drug Absorption," Critical Reviews in Therapeutic Drug Carrier Systems, 1991, 8(2):91-192.

Letsinger et al., "Cholesteryl-conjugated oligonucleotides: Synthesis, properties, and activity as inhibitors of replication of human immunodeficiency virus in cell culture," Proc. Natl. Acid. Sci. USA, 1989, 86:6553-6556.

Li et al., "Polyethylenimine-complexed Plasmid Particles Targeting Focal Adhesion Kinase Function as Melanoma Tumor Therapeutics," Mol. Ther., 2007, 15(3):515-523.

Lima & Raposo, "Towards the Identification of Molecular Biomarkers of Spinocerebellar Ataxia Type 3 (SCA3)/Machado-Joseph Disease (MJD)," Adv. Exp. Med. Biol., 2018, 1049:309-319.

Lima et al., "Single-Stranded siRNAs Activate RNAi in Animals," Cell, 2012, 150:883-894.

Liu, "Radiolabeled Multimeric Cyclic RGD Peptides as Integrin αvβ3 Targeted Radiotracers for Tumor Imaging," Mol. Pharm., 2006, 3(5):472-487.

Lizardi et al., "Exponential Amplification of Recombinant- RNA Hybridization Probes," Bio/Technology, 1988, 6:1197-1202.

Makimura et al., "Reducing hypothalamic AGRP by RNA interference increases metabolic rate and decreases body weight without influencing food intake," BMC Neurosci., 2002, 3:18, 6 pp.

Mannino & Gould-Fogerite, "Liposome Mediated Gene Transfer," Biotechniques, 1988, 6(7):682-690.

Manoharan et al., "Chemical Modifications to Improve Uptake and Bioavailability of Antisense Oligonucleotides," Ann. N.Y. Acad. Sci., 1992, 660:306-309.

Manoharan et al., "Introduction of a Lipophilic Thioether Tether in the Minor Groove of Nucleic Acids for Antisense Applications," Biorg. Med. Chem. Let., 1993, 3(12):2765-2770.

Manoharan et al., "Cholic Acid-Oligonucleotide Conjugates for Antisense Applications," Biorg. Med. Chem. Let., 1994, 4(8):1053-1060.

Manoharan et al., "Lipidic Nucleic Acids," Tetrahedron Lett., 1995, 36(21):3651-3654.

Manoharan et al., "Oligonucleotide Conjugates: Alteration of the Pharmacokinetic Properties of Antisense Agents," Nucleosides & Nucleotides, 1995, 14(3-5):969-973.

Martin et al., "A New Access to 2'-O-alkylated Ribonucleosides and Properties of 2'-O-Alkylated Oligoribonucleotides," Helv. Chim. Acta, 1995, 78:486-504 (including machine translation).

Matos et al., "Machado-Joseph disease/spinocerebellar ataxia type 3: lessons from disease pathogenesis and clues into therapy," J. Neurochem., 2019, 148:8-28.

Mayer et al., "Vesicles of variable sizes produced by a rapid extrusion procedure," Biochim. Biophys. Acta, 1986, 858:161-168.

Mayhew et al., "Characterization of Liposomes Prepared by Using a Microemulsifier," Biochim. Biophys. Acta, 1984, 775:169-174.

McLoughlin et al., "Oligonucleotide therapy mitigates disease in Spinocerebellar Ataxia Type 3 mice," Ann. Neurol., 2018, 84(1):64-77.

McNamara et al., "Cell type-specific delivery of siRNAs with aptamer-siRNA chimeras," Nat. Biotechnol., 2006, 24(8):1005-1015.

Mendonça et al., "Clinical Features of Machado-Joseph Disease," Adv. Exp. Med. Biol., 2018, 1049:255-273.

Mikhailov et al., "Synthesis of a New Class of Acyclic 2',5'- and 3',5'-Oligonucleotide Analogs Based on 9-[1,5-dihydroxy-4(S)-hydroxymethyl-3-oxapent-2(R)-yl]-adenine," Tetrahedron Letters, 1985, 26(17):2059-2062.

Mishra et al., "Improved leishmanicidal effect of phosphorotioate antisense oligonucleotides by LDL-mediated delivery," Biochim. Biophys. Acta, 1995, 1264:229-237.

Mook et al., "Evaluation of locked nucleic acid-modified small interfering RNA in vitro and in vivo," Mol Canc Ther, 2007, 6(3):833-843.

Moore et al., "Evaluation of Antisense Oligonucleotides Targeting ATXN3 in SCA3 Mouse Models," Mol. Ther. Nucleic Acids, 2017, 7:200-210.

Muranishi, "Absorption Enhancers," Critical Reviews in Therapeutic Drug Carrier Systems, 1990, 7(1):1-33.

Nabel et al., "Direct gene transfer wit DNA-liposome complexes in melanoma: Expression, biologic activity, and lack of toxicity in humans," Proc. Natl. Acad. Sci. USA, 1993, 90:11307-11311.

Nabel et al., "Gene Transfer In Vivo with DNA-Liposome Complexes: Lack of Autoimmunity and Gonadal Localization," Human Gene Ther., 1992, 3:649-656.

NCBI Reference Sequence: NM_001127697.2, "Homo sapiens ataxin 3 (ATXN3), transcript variant e, mRNA," Jul. 26, 2020.

NCBI Reference Sequence: NM_001164782.2, "Homo sapiens ataxin 3 (ATXN3), transcript variant ae, mRNA," May 22, 2023.

NCBI Reference Sequence: NM_029705.3, "Mus musculus ataxin 3 (Atxn3), transcript variant 1, mRNA," May 24, 2023.

NCBI Reference Sequence: XM_005595835.1, "Predicted: Macaca fascicularis ataxin 3 (ATXN3), transcript variant X1, mRNA," Sep. 19, 2013.

NCBI Reference Sequence: XM_006240493.3, "Predicted: Rattus norvegicus ataxin 3 (Atxn3), transcript variant X4, mRNA," Jul. 26, 2016.

Clinical Trial NCT02336633, "Resveratrol and Huntington Disease (REVHD)," ClinicalTrials.gov, 2020, 7 pp.

Nicolau et al., "Liposomes as Carriers for in Vivo Gene Transfer and Expression," Meth. Enzymol., 1987, 149:157-176.

Nielsen et al., "Sequence-Selective Recognition of DNA by Strand Displacement with a Thymine-Substituted Polyamide," Science, 1991, 254(5037):1497-1500.

Nishiyama et al., "Regional and Cellular Expression of the Machado-Joseph Disease Gene in Brains of Normal and Affected Individuals," Ann. Neurol., 1996, 40:776-781.

Nykänen et al., "ATP Requirements and Small Interfering RNA Structure in the RNA Interference Pathway," Cell, 2001, 107(3):309-321.

Oberhauser & Wagner, "Effective incorporation of 2'-O-methyl-oligoribonucleotides into liposomes and enhanced cell association through modification with thiocholesterol," Nucl. Acids Res., 1992, 20(3):533-538.

Olson et al., "Preparation of liposomes of defined size distribution by extrusion through polycarbonate membranes," Biochim. Biophys. Acta, 1979, 557(1):9-23.

Pal et al., "Systemic delivery of RafsiRNA using cationic cardiolipin liposomes silences Raf-1 expression and inhibits tumor growth in xenograft model of human prostate cancer," Int J. Oncol., 2005, 26:1087-1091.

Papahadjopoulos & Gabizon, "Targeting of Liposomes to Tumor Cells in Vivo," Ann. N.Y. Acad. Sci., 1987, 507(1):64-74.

Paulson, "Machado-Joseph Disease/Spinocerebellar Ataxia Type 3," Handb. Clin. Neurol., 2012, 103:437-449.

(56) References Cited

OTHER PUBLICATIONS

Paulson et al., "Machado-Joseph Disease Gene Product Is a Cytoplasmic Protein Widely Expressed in Brain," Ann. Neurol., 1997, 41:453-462.
Pillé et al., "Anti-RhoA and Anti-RhoC siRNAs Inhibit the Proliferation and Invasiveness of MDA-MB-231 Breast Cancer Cells in Vitro and in Vivo," Mol. Ther., 2005, 11(2):267-274.
Raposo, "Predicting and tracking Machado-Joseph disease: biomarkers of diagnosis and prognosis," PhD dissertation, Universidade dos Açores, 2017, 4 pp.
Raposo et al., "Novel Candidate Blood-Based Transcriptional Biomarkers of Machado-Joseph Disease," Mov. Disord., 2015, 30(7):968-975.
Reich et al., "Small interfering RNA (siRNA) targeting VEGF effectively inhibits ocular neovascularization in a mouse model," Mol. Vis., 2003, 9:210-216.
Ritschel, "Microemulsions for Improved Peptide Absorption from the Gastrointestinal Tract," Meth. Find. Exp. Clin. Pharmacol., 1991, 13(3):205-220.
Rodríguez-Lebrón et al., "Silencing Mutant ATXN3 Expression Resolves Molecular Phenotypes in SCA3 Transgenic Mice," Mol. Ther., 2013, 21(10):1909-1918.
Saison-Behmoaras et al., "Short modified antisense oligonucleotides directed against Ha-ras point mutation induce selective cleavage of the mRNA and inhibit T24 cells proliferation," Embo J, 1991, 10(5):1111-1118.
Schmitt et al., "Inactivation of the mouse Atxn3 (ataxin-3) gene increases protein ubiquitination," Biochem. Biophys. Res. Commun., 2007, 362:734-739.
Schöls et al., "Autosomal dominant cerebellar ataxias: clinical features, genetics, and pathogenesis," Lancet. Neurol., 2004, 3:291-304.
Sharp, "RNA interference—2001," Genes Dev., 2001, 15:485-490.
Shea et al., "Synthesis, hybridization properties and antiviral activity of lipid-oligodeoxynucleotide conjugates," Nucl. Acids Res., 1990, 18(13):3777-3783.
Shishkina et al., "Attenuation of α2A-Adrenergic Receptor Expression in Neonatal Rat Brain by RNA Interference or Antisense Oligonucleotide Reduced Anxiety in Adulthood," Neuroscience, 2004, 129:521-528.
Silva-Fernandes et al., "Motor uncoordination and neuropathology in a transgenic mouse model of Machado-Joseph disease lacking intranuclear inclusions and ataxin-3 cleavage products," Neurobiol. Dis., 2010, 40(1):163-176.
Simeoni et al., "Insight into the mechanism of the peptide-based gene delivery system MPG: implications for delivery of siRNA into mammalian cells," Nucl. Acids Res., 2003, 31(11):2717-2724.
SØrensen et al., "Gene Silencing by Systemic Delivery of Synthetic siRNAs in Adult Mice," J. Mol. Biol., 2003, 327:761-766.
Soutschek et al., "Therapeutic silencing of an endogenous gene by systemic administration of modified siRNAs," Nature, 2004, 432:173-178.
Straubinger & Papahadjopoulos, "Liposomes as Carriers for Intracellular Delivery of Nucleic Acids," Meth. Enzymol., 1983, 101:512-527.
Strauss & Jaenisch, "Molecular complementation of a collagen mutation in mammalian cells using yeast artificial chromosomes," Embo J., 1992, 11(2):417-422.
Svinarchuk et al., "Inhibition of HIV proliferation in MT-4 cells by antisense oligonucleotide conjugated to lipophilic groups," Biochimie, 1993, 75:49-54.
Szoka & Papahadjopoulos, "Procedure for preparation of liposomes with large internal aqueous space and high capture by reverse-phase evaporation," Proc. Natl. Acad. Sci., 1978, 75(9):4194-4198.
Takahashi et al., "The Use of a Perfluorochemical Emulsion as a Vascular Perfusate in Drug Absorption," J. Pharm. Pharmacol., 1988, 40:252-257.
Tan et al., "Gene knockdown with intrathecal siRNA of NMDA receptor NR2B subunit reduces formalin-induced nociception in the rat," Gene Ther., 2005, 12:59-66.

Tetko et al., "Prediction of n-Octanol/Water Partition Coefficients from PHYSPROP Database Using Artificial Neural Networks and E-State Indices," J. Chem. Inf. Comput. Sci., 2001, 41:1407-1421.
Thakker et al., "Neurochemical and behavioral consequences of widespread gene knockdown in the adult mouse brain by using nonviral RNA interference," Proc. Natl. Acad. Sci. U.S.A., 2004, 101(49):17270-17275.
Tolentino et al., "Intravitreal Injection of Vascular Endothelial Growth Factor Small Interfering RNA Inhibits Growth and Leakage in a Nonhuman Primate, Laser-Induced Model of Choroidal Neovascularization," Retina, 2004, 24(1):132-138.
Tomalia et al., "Dendrimers as multi-purpose nanodevices for oncology drug delivery and diagnostic imaging," Biochem. Soc. Trans., 2007, 35(1):61-67.
UniProt P54252, "ATX3_Human," 2023, 10 pp.
Verma et al., "Small Interfering RNAs Directed against—Catenin Inhibit the in Vitro and in Vivo Growth of Colon Cancer Cells," Clin. Cancer Res., 2003, 9:1291-1300.
Wang et al., "Six cases of SCA3/MJD patients that mimic hereditary spastic paraplegia in clinic," J. Neurol. Sci., 2009, 285:121-124.
Wang & Huang, "pH-sensitive immunoliposomes mediate target-cell-specific delivery and controlled expression of a foreign gene in mouse," Proc. Natl Acad. Sci. USA, 1987, 84:7851-7855.
Wang & Huang, "Plasmid DNA Adsorbed to pH-sensitive Liposomes Efficiently Transforms the Target Cells," Biochem. Biophys. Res. Commun., 1987, 147(3):980-985.
Weiner et al., "Liposomes: A Novel Topical Delivery System for Pharmaceutical and Cosmetic Applications," Journal of Drug Targeting, 1994, 2:405-410.
Wu et al., "Increased Microvascular Permeability Contributes to Preferential Accumulation of Stealth Liposomes in Tumor Tissue," Cancer Research, 1993, 53:3765-3770.
Yamamoto et al., "A Mechanistic Study on Enhancement of Rectal Permeability to Insulin in the Albino Rabbit," J. Pharm. Exp. Ther., 1992, 263(1):25-31.
Yamashita et al., "Effects of diclofenac sodium and disodium ethylenediaminetetraacetate on electrical parameters of the mucosal membrane and their relation to the permeability enhancing effects in the rat jejunum," J. Pharm. Pharmacol., 1987, 39:621-626.
Yamashita et al., "Effect of Adjuvants on Charge-Selective Permeability and Electrical Resistance of Rat Jejunal Membrane," J. Pharm. Sci., 1990, 79(7):579-583.
Yoo et al., "PAMAM Dendrimers as Delivery Agents for Antisense Oligonucleotides," Pharm. Res., 1999, 16:1799-1804.
Zhang et al., "Small Interfering RNA Targeting Heme Oxygenase-1 Enhances Ischemia-Reperfusion-induced Lung Apoptosis," J. Biol. Chem., 2004, 279(11):10677-10684.
Zhou et al., "Lipophilic polylysines mediate efficient DNA transfection in mammalian cells," Biochim. Biophys. Acta, 1991, 1065:8-14.
Zhou & Huang, "Targeted delivery of DNA by liposomes and polymers," Journal of Controlled Release, 1992, 19:269-274.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties," J. Org. Chem., 2009, 74:118-134.
Zimmermann et al., "RNAi-mediated gene silencing in non-human primates," Nature, 2006, 441:111-114.
Zitzmann et al., "Arginine-glycine-aspartic acid (RGD)-peptide binds to both tumor and tumor endothelial cells in vivo.," Cancer Res., 2002, 62:5139-5143.
Burnett et al., "The polyglutamine neurodegenerative protein ataxin 3 regulates aggresome formation," PNAS, 2005, 102(12):4330-4335.
Li et al., "Sequence-Dependent and Independent Inhibition Specific for Mutant Ataxin-3 by Small Interfering RNA," Ann Neurol, 2004, 56:124-129.
Sacco et al., "The deubiquitylase Ataxin-3 restricts PTEN transcription in lung cancer cells," Oncogene, 2014, 33:4265-4272.
Official Action issued Sep. 11, 2024, in European patent application No. 20825334.4.

(56)           References Cited

OTHER PUBLICATIONS

Aiba et al., "Allele-Selective Inhibition of Expression of Huntingtin and Ataxin-3 by RNA Duplexes Containing Unlocked Nucleic Acid Substitutions," Biochemistry, Dec. 23, 2013, 52(51):9329-9338.

Fiszer et al., "An evaluation of oligonucleotide-based therapeutic strategies for polyQ diseases," BMC Molecular Biology, 2012, 13:6, 12 pp.

Fiszer et al., "Oligonucleotide-based strategies to combat polyglutamine diseases," Nucleic Acids Research, 2014, 42(11):6787-6810.

Rodrigues et al., "Absence of ataxin-3 leads to cytoskeletal disorganization and increased cell death," Biochimica et Biophysica Acta, 2010, 1803:1154-1163.

International Search Report and Written Opinion issued Apr. 5, 2021 in PCT/US2020/061674.

* cited by examiner

AD-1103843  ● GNA  ⊗ F  ○ OMe  ▮ PS  GalNAc/GalNAc/GalNAc  VP sense: G A G U G A U C U A G G U G A U G C U A A — GalNAc/GalNAc/GalNAc antis: C C C U C A C U A G A U C C A C T A C G A U U — VP

AD-1069823  ◍ 2-C16  ⊗ F  ○ OMe  ▮ PS  GalNAc/GalNAc/GalNAc  VP sense: A G G A A G G U A U C U A U A U U A — GalNAc/GalNAc/GalNAc antis: U G U C C U U C A A U A A G A U A U A A U — VP

AD-414356  ⊗ F  ○ OMe  ▮ PS  GalNAc/GalNAc/GalNAc  VP sense: A U G C A U C G A C C A A A A C U U A U A — GalNAc/GalNAc/GalNAc antis: U C U A C G U A G C U G G U U U U G A A U A U — VP

AD-1069828  ◍ 2-C16  ⊗ F  ○ OMe  ▮ PS  GalNAc/GalNAc/GalNAc  VP sense: U G U C U U A G A A A C U G U C A G A A — GalNAc/GalNAc/GalNAc antis: G U A C A G A A A U C U U U G A C A G U C U U — VP

AD-1069829  ◍ 2-C16  ⊗ F  ○ OMe  ▮ PS  GalNAc/GalNAc/GalNAc  VP sense: U U U U A G C G G U U U G C A A A C A A A — GalNAc/GalNAc/GalNAc antis: U G A A A A U C G C C A A A C G U U U G U U U — VP

AD-1069830  ◍ 2-C16  ⊗ F  ○ OMe  ▮ PS  GalNAc/GalNAc/GalNAc  VP sense: G C G G U U U G C A A A C A A A A U G A A — GalNAc/GalNAc/GalNAc antis: A U C G C C A A A C G U U U G U U U U A C U U — VP

AD-1041266  ⊗ F  ○ OMe  ▮ PS  GalNAc/GalNAc/GalNAc  VP sense: G A G G C A U C A G C A A U U A A A G A — GalNAc/GalNAc/GalNAc antis: U U C U C C G U A G U C G U U A A U U U C U — VP

AD-368995  ● GNA  ⊗ F  ○ OMe  ▮ PS  GalNAc/GalNAc/GalNAc sense: A G C G G U U U G C A A A C A A A A U G A — GalNAc/GalNAc/GalNAc antis: A A U C G C C A A A C G U U U G T U U U A C U

AD-368996  ● GNA  ⊗ F  ○ OMe  ▮ PS  GalNAc/GalNAc/GalNAc sense: G C G G U U U G C A A A C A A A A U G A U — GalNAc/GalNAc/GalNAc antis: A U C G C C A A A C G U U U G U U U U A C U A

FIG. 1

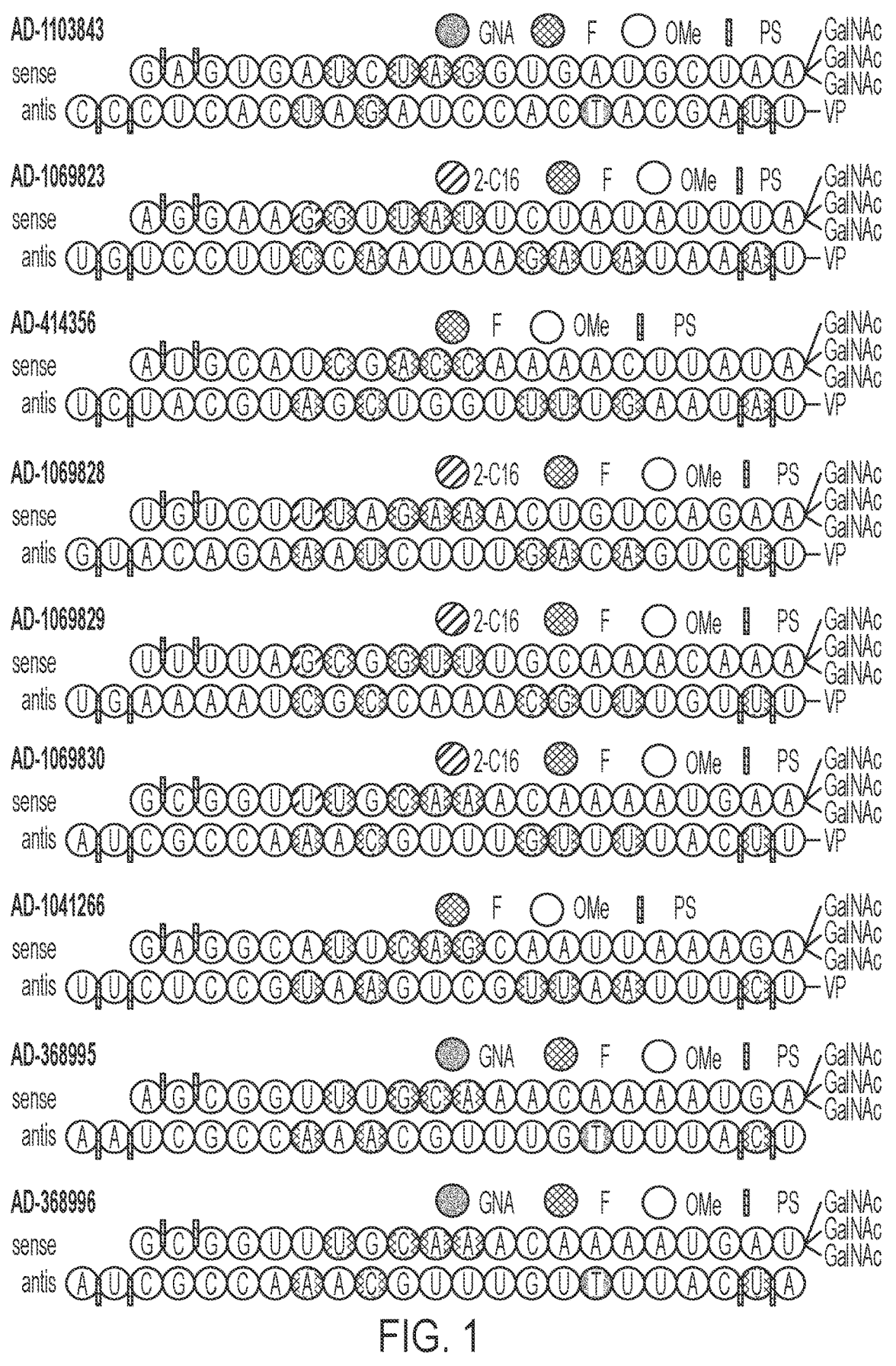

ATAXIN3 (ATXN3) RNAI AGENT COMPOSITIONS AND METHODS OF USE THEREOF

RELATED APPLICATIONS

This application claims priority to U.S. provisional application No. 62/939,437, filed on Nov. 22, 2019. The entire content of the foregoing application is hereby incorporated herein by reference.

BACKGROUND OF THE INVENTION

Spinocerebellar ataxias (SCAs) describe a large group of neurodegenerative disorders that affect movement, with more than 40 autosomal dominant SCAs described. As implied in the name, these disorders are characterized by progressive degeneration of the cerebellum and spinal motor neurons, however both the affected brain regions and the clinical features of SCAs vary depending on the subtype. Ataxia is the key feature of SCAs which is manifested as dysfunction of motor coordination affecting gait, balance and speech. While the initial symptoms of SCAs are predominantly cerebellar, the neuronal degeneration in SCA also affects brainstem, pyramidal and extrapyramidal neurons, oculomotor system, lower motor neurons, and peripheral nerves. Oculomotor symptoms include progressive external ophthalmoplegia (weakness of the eye muscles) and diplopia (double vision), the pyramidal symptoms include spasticity, hyperreflexia, and weakness, extrapyramidal symptoms include dystonia (continuous spasms and muscle contractions), tremors, bradykinesia (slowness of movement) and other symptoms that may resemble Parkinson's disease (Bettencourt and Lima (2011) *Orphanet journal of rare diseases* 6, 35-35). No disease modifying treatments exist for SCAs, however, physical therapy may improve symptoms (Ashizawa et al. (2018) *Nat Rev Neurol* 14, 590-605).

Spinocerebellar ataxia type 3 (SCA3), also known as Machado-Joseph Disease (MJD), is the most common type of spinocerebellar ataxias (Schöls et al. (2004) *Lancet Neurol* 3, 291-304). It represents about 20% of spinocerebellar ataxias in the US and up to 50% in Germany, Japan, and Portugal (Paulson (2012) *Handb Clin Neurol* 103, 437-449). SCA3 is caused by an expansion of trinucleotide (CAG) repeats in the coding region of Ataxin 3 (ATXN3) which encode poly-glutamine (polyQ) amino acid expansions in ATXN3 protein. Normal individuals have 12-44 repeats, while SCA3-affected individuals have approximately 52-86 repeats. The length of the expansion is correlated to the severity of the disease, there is also a strong inverse correlation between the repeat length and the age of onset, with longest expansions showing juvenile onset in SCA3 (Klockgether et al. (1996) *The Lancet* 348, 830). Based on the age of onset (and the correlated length of CAG expansion) SCA3 has been classified into three to four types: Type 1 (type "Joseph") with early onset and rapid progression (10 to 30 years of age, with mean onset at 24.3 years); Type 1 SCA is associated primarily with pyramidal and extrapyramidal symptoms that include spasticity, rigidity, and bradykinesia; ataxia is less frequent. Type 2 (type "Thomas") with an intermediate onset (20 to 50 years of age, with mean onset at 40.5 years); Type 2 patients are likely to have ataxia, dysarthria, and spastic paraplegia. Type 3 (type "Machado") with later onset (mean age at onset 46.8 years) (Bettencourt and Lima (2011) *Orphanet journal of rare diseases* 6, 35-35). Type 3 patients tend to have ataxia and peripheral polyneuropathy. SCA3 Type 4 is characterized by dopa-responsive parkinsonism, irrespective of the age of onset or progression (Wang et al. (2009) *J Neurol Sci* 285, 121-124). On anatomical level, SCA3 shows substantial loss of neurons in the dentate nucleus and substantia nigra, while the cortex of the cerebellum may be largely spared (Koeppen (2018) *Adv Exp Med Biol* 1049, 233-241; Mendonca et al. (2018) *Adv Exp Med Biol* 1049, 255-273).

ATXN3 is a 42 kDa protein, with most common isoform UniProt P54252, which contains an N-terminal domain with de-ubiquitinase activity and C-terminal containing ubiquitin-containing motifs (Matos et al. (2019) *Journal of Neurochemistry* 148, 8-28). It is believed to be a de-ubiquitinating enzyme (Doss-Pepe et al. (2003) *Mol Cell Biol* 23, 6469-6483). ATXN3 is ubiquitously expressed throughout the brain and the body. The cell specific ATXN3 phenotypes are believed to be due to the differential vulnerability neurons that are affected by SCA3 (Paulson (2012) *Handb Clin Neurol* 103, 437-449). In SCA3-unaffected individuals ATXN3 appears to be largely cytoplasmic but accumulates in neuronal nuclei in SCA3 patients (Nishiyama et al. (1996) *Ann Neurol* 40, 776-781; Paulson et al. (1997) *Ann Neurol* 41, 453-462). While its domain organization, protein-protein interactions, and sub-cellular localization imply important intracellular functions, ATXN3 knockout mice show no alterations in life span or fertility and have no obvious neurological or behavioral phenotypes (Schmitt et al. (2007) *Biochem Biophys Res Commun* 362, 734-739). Moreover, silencing ATXN3 resolved both molecular and behavioral phenotypes in mouse models of SCA3 (McLoughlin et al. (2018) *Ann Neurol* 84, 64-77; Moore et al. (2017) *Mol Ther Nucleic Acids* 7, 200-210; Rodriguez-Lebron et al. (2013) *Mol Ther* 21, 1909-1918).

BRIEF SUMMARY OF THE INVENTION

The present disclosure provides RNAi agents and compositions which effect the RNA-induced silencing complex (RISC)-mediated cleavage of RNA transcripts of an ataxin3 (ATXN3) gene. The ATXN3 gene may be within a cell, e.g., a cell within a subject, such as a human. The present disclosure also provides methods of using the RNAi agents and compositions of the disclosure for inhibiting the expression of an ATXN3 gene or for treating a subject who would benefit from inhibiting or reducing the expression of an ATXN3 gene, e.g., a subject suffering or prone to suffering from an ATXN3-associated disease.

The iRNA (e.g., RNAi or dsRNA) agents included in the compositions featured herein include an RNA strand (the antisense strand) having a region, e.g., a region that is 30 nucleotides or less, such as 19-24 nucleotides in length, that is substantially complementary to at least part of an mRNA transcript of ATXN3 (e.g., a human ATXN3). In some embodiments, the ATXN3 mRNA transcript is a human ATXN3 mRNA transcript, e.g., SEQ ID NO: 1 herein.

In some embodiments, the iRNA (e.g., dsRNA) agents described herein comprises an antisense strand having a region that is substantially complementary to a region of a human ATXN3 mRNA. In some embodiments, the human ATXN3 mRNA has the sequence NM_001127697.2 (SEQ ID NO: 1) or NM_001164782.2 (SEQ ID NO: 1918). In some embodiments, the human ATXN3 mRNA has the sequence NM_001127697.2 (SEQ ID NO: 1). The sequence of NM_001127697.2 is also herein incorporated by reference in its entirety. The reverse complement of SEQ ID NO: 1 is provided as SEQ ID NO: 2 herein. In some embodiments, the human ATXN3 mRNA has the sequence NM_001164782.2 (SEQ ID NO: 1918). The sequence of NM_001164782.2 is also herein incorporated by reference in its entirety. The reverse complement of SEQ ID NO: 1918 is provided as SEQ ID NO: 1919 herein.

Accordingly, the disclosure provides a double-stranded ribonucleic acid (dsRNA) agent for inhibiting expression of ATXN3, wherein the dsRNA agent comprises a sense strand and an antisense strand forming a double-stranded region, wherein the sense strand comprises a nucleotide sequence comprising at least 15 contiguous nucleotides, with 0 or 1 mismatches, of a portion of the nucleotide sequence of SEQ ID NO: 1 and the antisense strand comprises a nucleotide sequence comprising at least 15 contiguous nucleotides, with 0 or 1 mismatches, of the corresponding portion of nucleotide sequence of SEQ ID NO: 2 such that the sense strand is complementary to the at least 15 contiguous nucleotides in the antisense strand, wherein substitution of a thymidine base for a uridine base is not considered a mismatch.

In some embodiments, the dsRNA agent comprises a sense strand and an antisense strand forming a double-stranded region, wherein the sense strand comprises a nucleotide sequence comprising at least 15 contiguous nucleotides, with 0 or 1 mismatches, of a portion of the nucleotide sequence of SEQ ID NO: 1918 and the antisense strand comprises a nucleotide sequence comprising at least 15 contiguous nucleotides, with 0 or 1 mismatches, of the corresponding portion of nucleotide sequence of SEQ ID NO: 1919 such that the sense strand is complementary to the at least 15 contiguous nucleotides in the antisense strand, wherein substitution of a thymidine base for a uridine base is not considered a mismatch.

In certain embodiments, the dsRNA agent comprises a sense strand and an antisense strand, wherein the sense strand comprises a nucleotide sequence comprising at least 17 contiguous nucleotides, with 0 or 1 mismatches, of a portion of the nucleotide sequence of SEQ ID NO: 1 and the antisense strand comprises a nucleotide sequence comprising at least 17 contiguous nucleotides, with 0 or 1 mismatches, of the corresponding portion of nucleotide sequence of SEQ ID NO: 2 such that the sense strand is complementary to the at least 17 contiguous nucleotides in the antisense strand, wherein substitution of a thymidine base for a uridine base is not considered a mismatch.

In certain embodiments, the dsRNA agent comprises a sense strand and an antisense strand, wherein the sense strand comprises a nucleotide sequence comprising at least 17 contiguous nucleotides, with 0 or 1 mismatches, of a portion of the nucleotide sequence of SEQ ID NO: 1918 and the antisense strand comprises a nucleotide sequence comprising at least 17 contiguous nucleotides, with 0 or 1 mismatches, of the corresponding portion of nucleotide sequence of SEQ ID NO: 1919 such that the sense strand is complementary to the at least 17 contiguous nucleotides in the antisense strand, wherein substitution of a thymidine base for a uridine base is not considered a mismatch.

In certain embodiments, the dsRNA agent comprises a sense strand and an antisense strand, wherein the sense strand comprises a nucleotide sequence comprising at least 19 contiguous nucleotides, with 0 or 1 mismatches, of a portion of the nucleotide sequence of SEQ ID NO: 1 and the antisense strand comprises a nucleotide sequence comprising at least 19 contiguous nucleotides, with 0 or 1 mismatches, of the corresponding portion of nucleotide sequence of SEQ ID NO:2 such that the sense strand is complementary to the at least 19 contiguous nucleotides in the antisense strand, wherein substitution of a thymidine base for a uridine base is not considered a mismatch.

In certain embodiments, the dsRNA agent comprises a sense strand and an antisense strand, wherein the sense strand comprises a nucleotide sequence comprising at least 19 contiguous nucleotides, with 0 or 1 mismatches, of a portion of the nucleotide sequence of SEQ ID NO: 1918 and the antisense strand comprises a nucleotide sequence comprising at least 19 contiguous nucleotides, with 0 or 1 mismatches, of the corresponding portion of nucleotide sequence of SEQ ID NO: 1919 such that the sense strand is complementary to the at least 19 contiguous nucleotides in the antisense strand, wherein substitution of a thymidine base for a uridine base is not considered a mismatch.

In certain embodiments, the dsRNA agent comprises a sense strand and an antisense strand, wherein the sense strand comprises a nucleotide sequence comprising at least 21 contiguous nucleotides, with 0 or 1 mismatches, of a portion of the nucleotide sequence of SEQ ID NO: 1 and the antisense strand comprises a nucleotide sequence comprising at least 21 contiguous nucleotides, with 0 or 1 mismatches, of the corresponding portion of nucleotide sequence of SEQ ID NO: 2 such that the sense strand is complementary to the at least 21 contiguous nucleotides in the antisense strand, wherein substitution of a thymidine base for a uridine base is not considered a mismatch.

In certain embodiments, the dsRNA agent comprises a sense strand and an antisense strand, wherein the sense strand comprises a nucleotide sequence comprising at least 21 contiguous nucleotides, with 0 or 1 mismatches, of a portion of the nucleotide sequence of SEQ ID NO: 1918 and the antisense strand comprises a nucleotide sequence comprising at least 21 contiguous nucleotides, with 0 or 1 mismatches, of the corresponding portion of nucleotide sequence of SEQ ID NO: 1919 such that the sense strand is complementary to the at least 21 contiguous nucleotides in the antisense strand, wherein substitution of a thymidine base for a uridine base is not considered a mismatch.

In certain embodiments, the portion of the sense strand is a portion within nucleotides 76-96, 386-406, 477-497, 642-662, 897-917, 953-973, 1087-1107, 1109-1129, 1113-1133, 1114-1134, or 1200-1220 of SEQ ID NO: 1. In certain embodiments, the portion of the sense strand is a portion corresponding to SEQ ID NO: 724, 728, 837, 735, 740, 749, 752, 748, 749, 1806, 1026, 1852, 1835, 1840, 1841, or 1842.

In certain embodiments, the portion of the sense strand is a portion within a sense strand from a duplex in Table 4A, 4B, 7B. In certain embodiments, the portion of the sense strand is a portion within a chemically modified sense strand from a duplex in Table 2, 5, 7A, 10, 11, or 14.

In certain embodiments, the portion of the antisense strand is a portion within an antisense strand from a duplex in Table 4A, 4B, or 7B. In certain embodiments, the portion of the antisense strand is a portion within a chemically modified antisense strand from a duplex in Table 2, 5, 7A, 10, 11, or 14.

In certain embodiments, the portion of the sense strand and the portion of the antisense strand are portions within paired sense and antisense strands from a duplex in Table 4A, 4B, or 7B. In certain embodiments, the portion of the sense and antisense strands are portions of sense and antisense strands within a chemically modified antisense strand from a duplex in Table 2, 5, 7A, 10, 11, or 14.

In certain embodiments, the portion of the sense strand is a portion within a sense strand from a duplex selected from AD-368996 (GCGGUUUGCAAACAAAAUGAU (SEQ ID NO: 749)), AD-369082 (GCAUUCAGCAAUUAAAGA- CAU (SEQ ID NO: 752)), AD-414322 (UCGACCAAAAC-UUAUUGGAGA (SEQ ID NO: 837)), AD-368337 (AG-GAAGGUUAUUCUAUAUUUG (SEQ ID NO: 724)), AD-368871 (UGUCUUUAGAAACUGUCAGAA (SEQ ID NO: 740)), and AD-368815 (GAGUGAUCUAG-GUGAUGCUAU (SEQ ID NO: 735)). In certain embodiments, the portion is a portion of a corresponding chemically modified sequence provided in Table 2 or 5. In certain embodiments, the portion is a portion of a corresponding chemically modified sequence provided in Table 7A, 10, 11, or 14.

In certain embodiments, the portion of the sense strand is a portion within a sense strand from a duplex selected from AD-368995 (AGCGGUUUGCAAACAAAAUGA (SEQ ID NO: 748)), AD-368996 (GCG-GUUUGCAAACAAAAUGAU (SEQ ID NO: 749)), AD-1041266 (GAGGCAUUCAGCAAUUAAAGA (SEQ ID NO: 1806)), AD-414356 (AUGCAUCGACCAAAAC-UUAUA (SEQ ID NO: 1026)), AD-1103843 (GAGUGAUCUAGGUGAUGCUAA (SEQ ID NO: 1852)), AD-1069823 (AGGAAGGUUAUUCUAUAUUUA (SEQ ID NO: 1835)), AD-1069828 (UGUCUUUA-GAAACUGUCAGAA (SEQ ID NO: 1840)), AD-1069829 (UUUUAGCGGUUUGCAAACAAA (SEQ ID NO: 1841)), and AD-1069830 (GCGGUUUGCAAACAAAAUGAA (SEQ ID NO: 1842)).

In certain embodiments, the portion of the sense strand is a sense strand selected from the sense strands of AD-368996 (GCGGUUUGCAAACAAAAUGAU (SEQ ID NO: 749)), AD-369082 (GCAUUCAGCAAUUAAAGACAU (SEQ ID NO: 752)), AD-414322 (UCGACCAAAACUUAUUG-GAGA (SEQ ID NO: 837)), AD-368337 (AGGAAG-GUUAUUCUAUAUUUG (SEQ ID NO: 724)), AD-368871 (UGUCUUUAGAAACUGUCAGAA (SEQ ID NO: 740)), and AD-368815 (GAGUGAUCUAGGUGAUGCUAU (SEQ ID NO: 735)). In certain embodiments, the portion is a corresponding chemically modified sense strand sequence provided in Table 2 or 5. In certain embodiments, the portion is a portion of a corresponding chemically modified sequence provided in Table 7A, 10, 11, or 14.

In certain embodiments, the portion of the sense strand is a sense strand selected from the sense strands of AD-368995 (AGCGGUUUGCAAACAAAAUGA (SEQ ID NO: 748)), AD-368996 (GCGGUUUGCAAACAAAAUGAU (SEQ ID NO: 749)), AD-1041266 (GAGG-CAUUCAGCAAUUAAAGA (SEQ ID NO: 1806)), AD-414356 (AUGCAUCGACCAAAACUUAUA (SEQ ID NO: 1026)), AD-1103843 (GAGUGAUCUAGGUGAUGC-UAA (SEQ ID NO: 1852)), AD-1069823 (AGGAAG-GUUAUUCUAUAUUUA (SEQ ID NO: 1835)), AD-1069828 (UGUCUUUAGAAACUGUCAGAA (SEQ ID NO: 1840)), AD-1069829 (UUUUAGCG-GUUUGCAAACAAA (SEQ ID NO: 1841)), and AD-1069830 (GCGGUUUGCAAACAAAAUGAA (SEQ ID NO: 1842)).

In certain embodiments, the portion of the antisense strand is a portion within an antisense strand from a duplex selected from AD-368996 (AUCAUUTU-GUUUGCAAACCGCUA (SEQ ID NO: 885)), AD-369082 (AUGUCUUAAUUGCUGAAUGCCU (SEQ ID NO: 888)), AD-414322 (UCUCCAAUAAGUUUUGGU-CGAUG (SEQ ID NO: 973)), AD-368337 (CAAAUATA-GAAUAACCUUCCUGU (SEQ ID NO: 860)), AD-368871 (UUCUGACAGUUUCUAAAGACAUG (SEQ ID NO: 876)), and AD-368815 (AUAGCATCACCUAGAUCA-CUCCC (SEQ ID NO: 871)). In certain embodiments, the portions are portions of a corresponding chemically modified antisense strand sequence provided in Table 2 or 5. In certain embodiments, the portion is a portion of a corresponding chemically modified sequence provided in Table 7A, 10, 11, or 14.

In certain embodiments, the portion of the antisense strand is a portion within an antisense strand from a duplex selected from AD-368995 (UCAUUUT-GUUUGCAAACCGCUAA (SEQ ID NO: 884)), AD-368996 (AUCAUUTUGUUUGCAAACCGCUA (SEQ ID NO: 885)), AD-1041266 (UC-UUUAAUUGCUGAAUGCCUCUU (SEQ ID NO: 1865)), AD-414356 (UAUAAGUUUUGGUCGAUGCAUCU (SEQ ID NO: 1120)), AD-1103843 (UUAGCATCACCUA-GAUCACUCCC (SEQ ID NO: 1911)), AD-1069823 (UAAAUAUAGAAUAACCUUCCUGU (SEQ ID NO: 1894)), AD-1069828 (UUCUGACAGUUUCUAAAGA-CAUG (SEQ ID NO: 1899)), AD-1069829 (UUU-GUUUGCAAACCGCUAAAAGU (SEQ ID NO: 1900)), and AD-1069830 (UUCAUUUUGUUUGCAAACCGCUA (SEQ ID NO: 1901)).

In certain embodiments, the portion of antisense strand is an antisense strand selected from the antisense strands of AD-368996 (AUCAUUTUGUUUGCAAACCGCUA (SEQ ID NO: 885)), AD-369082 (AUGUCUTU-AAUUGCUGAAUGCCU (SEQ ID NO: 888)), AD-414322 (UCUCCAAUAAGUUUUGGUCGAUG (SEQ ID NO: 973)), AD-368337 (CAAAUATAGAAUAACCUUCCUGU (SEQ ID NO: 860)), AD-368871 (UUCUGACAGUUUC-UAAAGACAUG (SEQ ID NO: 876)), and AD-368815 (AUAGCATCACCUAGAUCACUCCC (SEQ ID NO: 871)). In certain embodiments, the portion is the correspond-ing chemically modified antisense strand sequence provided in Table 2 or 5. In certain embodiments, the portion is a portion of a corresponding chemically modified sequence provided in Table 7A, 10, 11, or 14.

In certain embodiments, the portion of antisense strand is an antisense strand selected from the antisense strands of AD-368995 (UCAUUUTGUUUGCAAACCGCUAA (SEQ ID NO: 884)), AD-368996 (AUCAUUTU-GUUUGCAAACCGCUA (SEQ ID NO: 885)), AD-1041266 (UCUUUAAUUGCUGAAUGCCUCUU (SEQ ID NO: 1865)), AD-414356 (UAUAAGUUUUGGU-CGAUGCAUCU (SEQ ID NO: 1120)), AD-1103843 (UUAGCATCACCUAGAUCACUCCC (SEQ ID NO: 1911)), AD-1069823 (UAAAUAUAGAAUAACCUUC-CUGU (SEQ ID NO: 1894)), AD-1069828 (UUCUGACAGUUUCUAAAGACAUG (SEQ ID NO: 1899)), AD-1069829 (UUUGUUUGCAAACCGC-UAAAAGU (SEQ ID NO: 1900)), and AD-1069830 (UU-CAUUUUGUUUGCAAACCGCUA (SEQ ID NO: 1901)).

In certain embodiments, the sense strand and antisense strand comprise nucleotide sequences of the paired sense strand and antisense strand of a duplex selected from AD-368996 (GCGGUUUGCAAACAAAAUGAU (SEQ ID NO: 749) and AUCAUUTUGUUUGCAAACCGCUA (SEQ ID NO: 885)), AD-369082 (GCAUUCAGCAAUUAAAGACAU (SEQ ID NO: 752) and AUGUCUTUAAUUGCUGAAUGCCU (SEQ ID NO: 888)), AD-414322 (UCGACCAAAACUUAUUGGAGA (SEQ ID NO: 837) and UCUCCAAUAAGUUUUGGU-CGAUG (SEQ ID NO: 973)), AD-368337 (AGGAAG-GUUAUUCUAUAUUUG (SEQ ID NO: 724) and CAAAUATAGAAUAACCUUCCUGU (SEQ ID NO: 860)), AD-368871 (UGUCUUUAGAAACUGUCAGAA (SEQ ID NO: 740) and UUCUGACAGUUUCUAAAGA-CAUG (SEQ ID NO: 876)), and AD-368815 (GAGUGAUCUAGGUGAUGCUAU (SEQ ID NO: 735) and AUAGCATCACCUAGAUCACUCCC (SEQ ID NO: 871)). In certain embodiments, the portions are corresponding chemically modified paired sense strand and antisense strand sequence provided in Table 2 or 5. In certain embodiments, the portion is a portion of a corresponding chemically modified sequence provided in Table 7A, 10, 11, or 14.

In certain embodiments, the sense strand and antisense strand comprise nucleotide sequences of the paired sense strand and antisense strand of a duplex selected from AD-368995 (AGCGGUUUGCAAACAAAAUGA (SEQ ID NO: 748) and UCAUUUTGUUUGCAAACCGCUAA (SEQ ID NO: 884)), AD-368996 (GCG-GUUUGCAAACAAAAUGAU (SEQ ID NO: 749) and AUCAUUTGUUUGCAAACCGCUA (SEQ ID NO: 885)), AD-1041266 (GAGGCAUUCAGCAAUUAAAGA (SEQ ID NO: 1806) and UCUUUAAUUGCUGAAUGC-CUCUU (SEQ ID NO: 1865)), AD-414356 (AUG-CAUCGACCAAAACUUAUA (SEQ ID NO: 1026) and UAUAAGUUUUGGUCGAUGCAUCU (SEQ ID NO: 1120)), AD-1103843 (GAGUGAUCUAGGUGAUGCUAA (SEQ ID NO: 1852) and UUAGCATCACCUAGAUCA-CUCCC (SEQ ID NO: 1911)), AD-1069823 (AGGAAG-GUUAUUCUAUAUUUA (SEQ ID NO: 1835) and UAAAUAUAGAAUAACCUUCCUGU (SEQ ID NO: 1894)), AD-1069828 (UGUCUUUAGAAACUGUCAGAA (SEQ ID NO: 1840) and UUCUGACAGUUUCUAAAGA-CAUG (SEQ ID NO: 1899)), AD-1069829 (UUUUAGCG-GUUUGCAAACAAA (SEQ ID NO: 1841) and UUU-GUUUGCAAACCGCUAAAAGU (SEQ ID NO: 1900)), and AD-1069830 (GCGGUUUGCAAACAAAAUGAA (SEQ ID NO: 1842) and UUCAUUUU-GUUUGCAAACCGCUA (SEQ ID NO: 1901)).

In certain embodiments, the dsRNA agent comprises at least one modified nucleotide.

In certain embodiments, the dsRNA agent is substantially modified such that no more than five of the sense strand nucleotides and not more than five of the nucleotides of the antisense strand are unmodified nucleotides. In certain embodiments, all of the nucleotides of the sense strand and all of the nucleotides of the antisense strand comprise a modification.

In certain embodiments, at least one of the modified nucleotides is selected from the group a deoxy-nucleotide, a 3'-terminal deoxy-thymine (dT) nucleotide, a 2'-O-methyl modified nucleotide, a 2'-fluoro modified nucleotide, a 2'-de-oxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phospho-rothioate group, a nucleotide comprising a 5'-methylphos-phonate group, a nucleotide comprising a 5'-phosphate or 5'-phosphate mimic, a nucleotide comprising vinyl phos-phonate, a nucleotide comprising adenosine-glycol nucleic acid (GNA), a nucleotide comprising thymidine-glycol nucleic acid (GNA) S-Isomer, a nucleotide comprising 2-hy-droxymethyl-tetrahydrofurane-5-phosphate, a nucleotide comprising 2'-deoxythymidine-3'phosphate, a nucleotide comprising 2'-deoxyguanosine-3'-phosphate, and a terminal nucleotide linked to a cholesteryl derivative and a dode-canoic acid bisdecylamide group; and combinations thereof. Optionally, the modified nucleotide is selected from the group consisting of a 2'-deoxy-2'-fluoro modified nucleo-tide, a 2'-deoxy-modified nucleotide, 3'-terminal deoxy-thymine nucleotides (dT), a locked nucleotide, an abasic nucleotide, a 2'-amino-modified nucleotide, a 2'-alkyl-modi-fied nucleotide, a morpholino nucleotide, a phosphorami-date, and a non-natural base comprising nucleotide.

Optionally, the modified nucleotide comprises a short sequence of 3'-terminal deoxy-thymine nucleotides (dT).

Optionally, the modifications on the nucleotides are 2'-O-methyl, GNA, and 2'-fluoro modifications.

In certain embodiments, the modifications further com-prise at least one phosphorothioate internucleotide linkage. In certain embodiments, the dsRNA agent comprises 6-8 phosphorothioate internucleotide linkages.

In certain embodiments, each strand of the dsRNA agent is no more than 30 nucleotides in length.

In certain embodiments, at least one strand comprises a 3'-overhang of at least 1 nucleotide, optionally, at least one strand comprises a 3'-overhang of at least 2 nucleotides.

In certain embodiments, the double-stranded region of the dsRNA agent is 15-30 nucleotide pairs in length, optionally 17-23 nucleotide pairs in length, 17-25 nucleotide pairs in length, 23-27 nucleotide pairs in length, 19-21 nucleotide pairs in length, or 21-23 nucleotide pairs in length. In certain embodiments, the double-stranded region is 19-21 nucleo-tide pairs in length.

In certain embodiments, each strand of the dsRNA agent has 19-30 nucleotides. Optionally, each strand has 19-23 nucleotides or 21-23 nucleotides. In certain embodiments, each strand has 21-23 nucleotides.

In certain embodiments, one or more lipophilic moieties are conjugated to one or more internal positions on at least one strand. In certain embodiments, the one or more lipo-philic moieties are conjugated to one or more internal positions on at least one strand via a linker or carrier.

In certain embodiments, in the dsRNA agent, the base pair at the 1 position of the 5'-end of the antisense strand of the duplex is an AU base pair.

In certain embodiments, the dsRNA agent further com-prises a terminal, the sense strand has a total of 21 nucleo-tides and the antisense strand has a total of 23 nucleotides.

In certain embodiments, the lipophilicity of the lipophilic moiety, measured by log $K_{ow}$, exceeds 0.

In some embodiments, the hydrophobicity of the double-stranded RNAi agent, measured by the unbound fraction in a plasma protein binding assay of the double-stranded RNAi agent, exceeds 0.2. In a related embodiment, the plasma protein binding assay is an electrophoretic mobility shift assay using human serum albumin protein.

In certain embodiments, all of the nucleotides of the sense strand are modified nucleotides.

In some embodiments, substantially all of the nucleotides of the antisense strand are modified nucleotides. Optionally, all of the nucleotides of the sense strand are modified nucleotides.

In certain embodiments, all of the nucleotides of the antisense strand are modified nucleotides. Optionally, all of the nucleotides of the sense strand and all of the nucleotides of the antisense strand are modified nucleotides.

In one embodiment, at least one of the modified nucleo-tides is a deoxy-nucleotide, a 3'-terminal deoxy-thymine (dT) nucleotide, a 2'-O-methyl modified nucleotide, a 2'-fluoro modified nucleotide, a 2'-deoxy-modified nucleo-tide, a locked nucleotide, an unlocked nucleotide, a confor-mationally restricted nucleotide, a constrained ethyl nucleo-tide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5'-phosphate or 5'-phosphate mimic, a nucleotide comprising vinyl phosphonate, a nucleotide comprising adenosine-glycol nucleic acid (GNA), a nucleotide comprising thymidine-glycol nucleic acid (GNA) S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, or a terminal nucleotide linked to a cholesteryl derivative or a dodecanoic acid bisdecylamide group.

In a related embodiment, the modified nucleotide is a 2'-deoxy-2'-fluoro modified nucleotide, a 2'-deoxy-modified nucleotide, 3'-terminal deoxy-thymine nucleotides (dT), a locked nucleotide, an abasic nucleotide, a 2'-amino-modified nucleotide, a 2'-alkyl-modified nucleotide, a morpholino nucleotide, a phosphoramidate, or a non-natural base comprising nucleotide.

In one embodiment, the modified nucleotide includes a short sequence of 3'-terminal deoxy-thymine nucleotides (dT).

In another embodiment, the modifications on the nucleotides are 2'-O-methyl, 2'-fluoro and GNA modifications.

In an additional embodiment, the double-stranded RNAi agent includes at least one phosphorothioate internucleotide linkage. Optionally, the double-stranded RNAi agent includes 6-8 phosphorothioate internucleotide linkages.

In certain embodiments, the region of complementarity is at least 17 nucleotides in length. Optionally, the region of complementarity is 19-23 nucleotides in length. Optionally, the region of complementarity is 19 nucleotides in length.

In one embodiment, each strand is no more than 30 nucleotides in length.

In another embodiment, at least one strand includes a 3'-overhang of at least 1 nucleotide. Optionally, at least one strand includes a 3'-overhang of at least 2 nucleotides.

In certain embodiments, at least one of the sense strand and the antisense strand is conjugated to one or more lipophilic moieties.

In certain embodiments, the lipophilic moiety is conjugated to one or more positions in the double-stranded region of the dsRNA agent. In certain embodiments, the lipophilic moiety is conjugated via a linker or carrier.

In certain embodiments, lipophilicity of the lipophilic moiety, measured by log Kow, exceeds 0.

In certain embodiments, the hydrophobicity of the double-stranded RNAi agent, measured by the unbound fraction in a plasma protein binding assay of the double-stranded RNAi agent, exceeds 0.2. In certain embodiments, the plasma protein binding assay is an electrophoretic mobility shift assay using human serum albumin protein.

In certain embodiments, the double-stranded RNAi agent further includes a lipophilic ligand, e.g., a C16 ligand, conjugated to the 3'-end of the sense strand through a monovalent or branched bivalent or trivalent linker.

In one embodiment, the ligand is where B is a nucleotide base or a nucleotide base analog, optionally where B is adenine, guanine, cytosine, thymine or uracil.

In certain embodiments, the lipophilic moiety is linked to an internal positon on at least one strand of the dsRNA agent. Optionally, the internal positions include all position in the double-stranded portion of the dsRNA agent, i.e., not in an overhang. Optionally, the internal positions include all positions except the terminal two positions from each end of the at least one strand. Optionally, the internal positions include all positions except the terminal three positions from each end of the at least one strand.

In certain embodiments, the internal positions exclude a cleavage site region of the sense strand. In some embodiments, the internal positions exclude positions 9-12, counting from the 5'-end of the sense strand. In certain embodiments, the sense strand is 21 nucleotides in length.

In other embodiments, the internal positions exclude positions 11-13, counting from the 3'-end of the sense strand. Optionally, the internal positions exclude the cleavage site region of the antisense strand. In certain embodiments, the sense strand is 21 nucleotides in length.

In some embodiments, the internal positions exclude positions 12-14, counting from the 5'-end of the antisense strand. In certain embodiments, the antisense strand is 23 nucleotides in length.

In another embodiment, the internal positions excluding positions 11-13 on the sense strand, counting from the 3'-end, and positions 12-14 on the antisense strand, counting from the 5'-end. In certain embodiments, the sense strand is 21 nucleotides in length and the antisense strand is 23 nucleotides in length.

In an additional embodiment, one or more lipophilic moieties are conjugated to one or more of the following internal positions: positions 4-8 and 13-18 on the sense strand, and positions 6-10 and 15-18 on the antisense strand, counting from the 5'end of each strand. Optionally, one or more lipophilic moieties are conjugated to one or more of the following internal positions: positions 5, 6, 7, 15, and 17 on the sense strand, and positions 15 and 17 on the antisense strand, counting from the 5'-end of each strand. In certain embodiments, the sense strand is 21 nucleotides in length and the antisense strand is 23 nucleotides in length.

In certain embodiments, the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand. In certain embodiments, the lipophilic moiety is conjugated to position 21, position 20, position 15, position 1, or position 7 of the sense strand. In certain embodiments, the lipophilic moiety is conjugated to position 21, position 20, or position 15 of the sense strand. In certain embodiments, the lipophilic moiety is conjugated to position 20 or position 15 of the sense strand. In certain embodiments, the lipophilic moiety is conjugated to position 16 of the antisense strand. In certain embodiments, the lipophilic moiety is conjugated to position 6, counting from the 5'-end of the sense strand.

In certain embodiments, the lipophilic moiety is an aliphatic, alicyclic, or polyalicyclic compound. Optionally, the lipophilic moiety is lipid, cholesterol, retinoic acid, cholic acid, adamantane acetic acid, 1-pyrene butyric acid, dihydrotestosterone, 1,3-bis-O(hexadecyl)glycerol, geranyloxy-hexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine.

In some embodiments, the lipophilic moiety contains a saturated or unsaturated $C_4$-$C_{30}$ hydrocarbon chain, and an optional functional group selected that is hydroxyl, amine, carboxylic acid, sulfonate, phosphate, thiol, azide, or alkyne.

In certain embodiments, the lipophilic moiety contains a saturated or unsaturated $C_6$-$C_{18}$ hydrocarbon chain. Optionally, the lipophilic moiety contains a saturated or unsaturated $C_{16}$ hydrocarbon chain. In a related embodiment, the lipophilic moiety is conjugated via a carrier that replaces one or more nucleotide(s) in the internal position(s). In certain embodiments, the carrier is a cyclic group that is pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, or decalinyl; or is an acyclic moiety based on a serinol backbone or a diethanolamine backbone.

In some embodiments, the lipophilic moiety is conjugated to the double-stranded RNAi agent via a linker containing an ether, thioether, urea, carbonate, amine, amide, maleimide-thioether, disulfide, phosphodiester, sulfonamide linkage, a product of a click reaction, or carbamate.

In one embodiment, the lipophilic moiety is conjugated to a nucleobase, sugar moiety, or internucleosidic linkage. Optionally, the lipophilic moiety or targeting ligand is conjugated via a bio-cleavable linker selected from the group DNA, RNA, disulfide, amide, functionalized monosaccharides or oligosaccharides of galactosamine, glucosamine, glucose, galactose, mannose, and combinations thereof.

In another embodiment, the double-stranded RNAi agent further includes a phosphate or phosphate mimic at the 5'-end of the antisense strand. Optionally, the phosphate mimic is a 5'-vinyl phosphonate (VP).

In certain embodiments, the double-stranded RNAi agent further includes a targeting ligand that targets a receptor which mediates delivery to a CNS tissue, e.g., a hydrophilic ligand. In certain embodiments, the targeting ligand is a C16 ligand.

In some embodiments, the double-stranded RNAi agent further includes a targeting ligand that targets a brain tissue.

In one embodiment, the lipophilic moiety or targeting ligand is conjugated via a bio-cleavable linker that is DNA, RNA, disulfide, amide, functionalized monosaccharides or oligosaccharides of galactosamine, glucosamine, glucose, galactose, mannose, or a combination thereof.

In a related embodiment, the 3'-end of the sense strand is protected via an end cap which is a cyclic group having an amine, the cyclic group being pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, or decalinyl.

In one embodiment, the RNAi agent includes at least one modified nucleotide that is a 2'-O-methyl modified nucleotide, a 2'-fluoro modified nucleotide, a nucleotide that includes a glycol nucleic acid (GNA) or a nucleotide that includes a vinyl phosphonate. Optionally, the RNAi agent includes at least one of each of the following modifications: 2'-O-methyl modified nucleotide, a 2'-fluoro modified nucleotide, a nucleotide comprising a glycol nucleic acid (GNA) and a nucleotide comprising vinyl phosphonate.

In another embodiment, the RNAi agent includes a pattern of modified nucleotides as provided below in Tables 2, 5, 7A, 10, 11, and 14 where locations of 2'-C16, 2'-O-methyl, GNA, phosphorothioate and 2'-fluoro modifications, irrespective of the individual nucleotide base sequences of the displayed RNAi agents.

In certain embodiments, the dsRNA agent further comprises a terminal, chiral modification occurring at the first internucleotide linkage at the 3'-end of the antisense strand, having the linkage phosphorus atom in Sp configuration, a terminal, chiral modification occurring at the first internucleotide linkage at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp configuration or Sp configuration.

In certain embodiments, the dsRNA agent further comprises a terminal, chiral modification occurring at the first and second internucleotide linkages at the 3'-end of the antisense strand, having the linkage phosphorus atom in Sp configuration, a terminal, chiral modification occurring at the first internucleotide linkage at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp or Sp configuration.

In certain embodiments, the dsRNA agent further comprises a terminal, chiral modification occurring at the first, second and third internucleotide linkages at the 3'-end of the antisense strand, having the linkage phosphorus atom in Sp configuration, a terminal, chiral modification occurring at the first internucleotide linkage at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp or Sp configuration.

In certain embodiments, the dsRNA agent further comprises a terminal, chiral modification occurring at the first, and second internucleotide linkages at the 3'-end of the antisense strand, having the linkage phosphorus atom in Sp configuration, a terminal, chiral modification occurring at the third internucleotide linkages at the 3'-end of the antisense strand, having the linkage phosphorus atom in Rp configuration, a terminal, chiral modification occurring at the first internucleotide linkage at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp or Sp configuration.

In certain embodiments, the dsRNA agent further comprises a terminal, chiral modification occurring at the first, and second internucleotide linkages at the 3'-end of the antisense strand, having the linkage phosphorus atom in Sp configuration, a terminal, chiral modification occurring at the first, and second internucleotide linkages at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp or Sp configuration.

Another aspect of the instant disclosure provides a double-stranded RNAi agent for inhibiting expression of an ATXN3 gene, where the double-stranded RNAi agent includes a sense strand complementary to an antisense strand, where the antisense strand includes a region complementary to part of an mRNA encoding ATXN3, where each strand is about 14 to about 30 nucleotides in length, where the double-stranded RNAi agent is represented by formula (III):

$$(III)$$

sense:
5' $n_p$ -$N_a$ -(X X X )$_i$-$N_b$ -Y Y Y -$N_b$ -

(Z Z Z )$_j$-$N_a$ -$n_q$ 3' antisense:
3' $n_p$'-$N_a$'-(X'X'X')$_k$-$N_b$'-Y'Y'Y'-$N_b$'-

(Z'Z'Z')$_l$-$N_a$'-$n_q$' 5' where:

j, k, and l are each independently 0 or 1;

p, p', q, and q' are each independently 0-6;

each $N_a$ and $N_a$' independently represents an oligonucleotide sequence including 0-25 nucleotides which are either modified or unmodified or combinations thereof, each sequence including at least two differently modified nucleotides;

each $N_b$ and $N_b$' independently represents an oligonucleotide sequence including 0-10 nucleotides which are either modified or unmodified or combinations thereof;

each $n_p$, $n_p$', $n_q$, and $n_q$', each of which may or may not be present, independently represents an overhang nucleotide;

XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b$' differ from the modification on Y'; and where the sense strand is conjugated to at least one ligand.

In one embodiment, i is 0; j is 0; i is 1; j is 1; both i and j are 0; or both i and j are 1.

In another embodiment, k is 0; l is 0; k is 1; l is 1; both k and l are 0; or both k and l are 1.

In certain embodiments, XXX is complementary to X'X'X', YYY is complementary to Y'Y'Y', and ZZZ is complementary to Z'Z'Z'.

In another embodiment, the YYY motif occurs at or near the cleavage site of the sense strand.

In an additional embodiment, the Y'Y'Y' motif occurs at the 11, 12 and 13 positions of the antisense strand from the 5'-end. Optionally, the Y' is 2'-O-methyl.

In some embodiments, formula (III) is represented by formula (IIIa):

$$(IIIa)$$

sense:
5' $n_p$ -$N_a$ -Y Y Y -$N_a$ -$n_q$ 3' antisense:
3' $n_p$'-$N_a$'-Y'Y'Y'-$N_a$'-$n_q$' 5'.

In another embodiment, formula (III) is represented by formula (IIIb):

$$(IIIb)$$

sense:
5' $n_p$ -$N_a$ -Y Y Y -$N_b$ -Z Z Z -$N_a$ -$n_q$ 3' antisense:
3' $n_p$'-$N_a$'-Y'Y'Y'-$N_b$'-Z'Z'Z'-$N_a$'-$n_q$' 5' where each $N_b$ and $N_b$' independently represents an oligonucleotide sequence including 1-5 modified nucleotides.

In an additional embodiment, formula (III) is represented by formula (IIIc):

$$(IIIc)$$

sense:
5' $n_p$ -$N_a$ -X X X -$N_b$ -Y Y Y -$N_a$ -$n_q$ 3' antisense:
3' $n_p$'-$N_a$'-X'X'X'-$N_b$'-Y'Y'Y'-$N_a$'-$n_q$' 5' where each $N_b$ and $N_b$' independently represents an oligonucleotide sequence including 1-5 modified nucleotides.

In certain embodiments, formula (III) is represented by formula (IIId):

$$(IIId)$$

sense:
5' $n_p$ -$N_a$ -X X X- $N_b$ -Y Y Y -$N_b$ -Z Z Z -$N_a$ - $n_q$ 3' antisense:
3' $n_p$'-$N_a$'- X'X'X'- $N_b$'-Y'Y'Y'-$N_b$'-Z'Z'Z'- $N_a$'- $n_q$'

5' where each $N_b$ and $N_b$' independently represents an oligonucleotide sequence including 1-5 modified nucleotides and each $N_a$ and $N_a$' independently represents an oligonucleotide sequence including 2-10 modified nucleotides.

In another embodiment, the double-stranded region is 15-30 nucleotide pairs in length. Optionally, the double-stranded region is 17-23 nucleotide pairs in length.

In certain embodiments, the double-stranded region is 17-25 nucleotide pairs in length. Optionally, the double-stranded region is 23-27 nucleotide pairs in length.

In some embodiments, the double-stranded region is 19-21 nucleotide pairs in length. Optionally, the double-stranded region is 21-23 nucleotide pairs in length.

In certain embodiments, each strand has 15-30 nucleotides. Optionally, each strand has 19-30 nucleotides. Optionally, each strand has 19-23 nucleotides.

In certain embodiments, the double-stranded region is 19-21 nucleotide pairs in length and each strand has 19-23 nucleotides.

In another embodiment, the modifications on the nucleotides of the RNAi agent are LNA, glycol nucleic acid (GNA), HNA, CeNA, 2'-methoxyethyl, 2'-O-alkyl, 2'-O-allyl, 2'-C-allyl, 2'-fluoro, 2'-deoxy or 2'-hydroxyl, and combinations thereof. Optionally, the modifications on nucleotides include 2'-O-methyl, 2'-fluoro or GNA, and combinations thereof. In a related embodiment, the modifications on the nucleotides are 2'-O-methyl or 2'-fluoro modifications.

In one embodiment the RNAi agent includes a ligand that is or includes one or more lipophilic, e.g, C16, moieties attached through a bivalent or trivalent branched linker.

In certain embodiments, the ligand is attached to the 3'-end of the sense strand.

In some embodiments, the RNAi agent further includes at least one phosphorothioate or methylphosphonate internucleotide linkage. In a related embodiment, the phosphorothioate or methylphosphonate internucleotide linkage is at the 3'-terminus of one strand. Optionally, the strand is the antisense strand. In another embodiment, the strand is the sense strand. In a related embodiment, the phosphorothioate or methylphosphonate internucleotide linkage is at the 5'-terminus of one strand. Optionally, the strand is the antisense strand. In another embodiment, the strand is the sense strand.

In another embodiment, the phosphorothioate or methylphosphonate internucleotide linkage is at the both the 5'- and 3'-terminus of one strand. Optionally, the strand is the antisense strand. In another embodiment, the strand is the sense strand.

In an additional embodiment, the base pair at the 1 position of the 5'-end of the antisense strand of the RNAi agent duplex is an A:U base pair.

In certain embodiments, the Y nucleotides contain a 2'-fluoro modification.

In some embodiments, the Y' nucleotides contain a 2'-O-methyl modification.

In certain embodiments, p'>0. Optionally, p'=2.

In some embodiments, q'=0, p=0, q=0, and p' overhang nucleotides are complementary to the target mRNA.

In certain embodiments, q'=0, p=0, q=0, and p' overhang nucleotides are noncomplementary to the target mRNA.

In one embodiment, the sense strand of the RNAi agent has a total of 21 nucleotides and the antisense strand has a total of 23 nucleotides.

In another embodiment, at least one $n_p$ is linked to a neighboring nucleotide via a phosphorothioate linkage. Optionally, all $n_p$' are linked to neighboring nucleotides via phosphorothioate linkages.

In certain embodiments, the ATXN3 RNAi agent of the instant disclosure is one of those listed in Tables 2, 4A, 4B, 5, 7A, 7B, 10, 11, and 14. In some embodiments, all of the nucleotides of the sense strand and all of the nucleotides of the antisense strand include a modification.

Another aspect of the instant disclosure provides a double-stranded RNAi agent for inhibiting expression of an ATXN3 gene in a cell, where the double-stranded RNAi agent includes a sense strand complementary to an antisense strand, where the antisense strand includes a region complementary to part of an mRNA encoding ATXN3 gene, where each strand is about 14 to about 30 nucleotides in length, where the double-stranded RNAi agent is represented by formula (III):

(III)

sense:
5' $n_P$-$N_a$-(X X X)$_i$-$N_b$-Y Y Y -$N_b$-(Z Z Z)$_j$-$N_a$ - $n_q$ 3' antisense:
3' $n_p$'-$N_a$'-(X'X'X')$_k$-$N_b$'-Y'Y'Y'-$N_b$'-(Z'Z'Z')$_l$-$N_a$'- $n_q$'
5' where:
j, k, and l are each independently 0 or 1;
p, p', q, and q' are each independently 0-6;
each $N_a$ and $N_a$' independently represents an oligonucleotide sequence including 0-25 nucleotides which are either modified or unmodified or combinations thereof, each sequence including at least two differently modified nucleotides;
each $N_b$ and $N_b$' independently represents an oligonucleotide sequence including 0-10 nucleotides which are either modified or unmodified or combinations thereof;
each $n_p$, $n_p$', $n_q$, and $n_q$', each of which may or may not be present independently represents an overhang nucleotide;
XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;
modifications on $N_b$ differ from the modification on Y and modifications on $N_b$' differ from the modification on Y'; and
where the sense strand is conjugated to at least one ligand.

An additional aspect of the instant disclosure provides a double-stranded RNAi agent for inhibiting expression of an ATXN3 gene in a cell, where the double-stranded RNAi agent includes a sense strand complementary to an antisense strand, where the antisense strand includes a region complementary to part of an mRNA encoding ATXN3, where each strand is about 14 to about 30 nucleotides in length, where the double-stranded RNAi agent is represented by formula (III):

(III)

sense:
5' $n_P$ -$N_a$ -(X X X)$_i$-$N_b$-Y Y Y -$N_b$-(Z Z Z)$_j$-$N_a$ - $n_q$ 3' antisense:
3' $n_p$'-$N_a$'-(X'X'X')$_k$-$N_b$'-Y'Y'Y'-$N_b$'-(Z'Z'Z')$_l$-$N_a$'- $n_q$'
5' where:
j, k, and l are each independently 0 or 1;
each $n_p$, $n_q$, and $n_q$', each of which may or may not be present, independently represents an overhang nucleotide;
p, q, and q' are each independently 0-6;
$n_p$'>0 and at least one $n_p$' is linked to a neighboring nucleotide via a phosphorothioate linkage;
each $N_a$ and $N_a$' independently represents an oligonucleotide sequence including 0-25 nucleotides which are either modified or unmodified or combinations thereof, each sequence including at least two differently modified nucleotides;
each $N_b$ and $N_b$' independently represents an oligonucleotide sequence including 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and where the modifications are 2'-O-methyl, glycol nucleic acid (GNA) or 2'-fluoro modifications;
modifications on $N_b$ differ from the modification on Y and modifications on $N_b$' differ from the modification on Y'; and
where the sense strand is conjugated to at least one ligand.

Another aspect of the instant disclosure provides a double-stranded RNAi agent for inhibiting expression of an ATXN3 gene in a cell, where the double-stranded RNAi agent includes a sense strand complementary to an antisense strand, where the antisense strand includes a region complementary to part of an mRNA encoding ATXN3 (SEQ ID NO: 1), where each strand is about 14 to about 30 nucleotides in length, where the double-stranded RNAi agent is represented by formula (III):

(III)

sense:
5' $n_p$-$N_a$ - (X X X)$_i$-$N_b$ -Y Y Y -$N_b$ - (Z Z Z)$_j$-$N_a$ - $n_q$ 3' antisense:
3' $n_p$'-$N_a$'-(X'X'X')$_k$-$N_b$'-Y'Y'Y'-$N_b$'-(Z'Z'Z')$_l$-$N_a$'- $n_q$' 5' where:

j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence including 0-25 nucleotides which are either modified or unmodified or combinations thereof, each sequence including at least two differently modified nucleotides;

each $N_b$ and $N_b$' independently represents an oligonucleotide sequence including 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;

modifications on $N_b$ differ from the modification on Y and modifications on $N_b$' differ from the modification on Y'; and where the sense strand is conjugated to at least one ligand, optionally where the ligand is one or more lipophilic, e.g., C16, ligands.

An additional aspect of the instant disclosure provides a double-stranded RNAi agent for inhibiting expression of an ATXN3 gene in a cell, where the double-stranded RNAi agent includes a sense strand complementary to an antisense strand, where the antisense strand includes a region complementary to part of an mRNA encoding ATXN3 (SEQ ID NO: 1), where each strand is about 14 to about 30 nucleotides in length, where the double-stranded RNAi agent is represented by formula (III):

(III)

sense:
5' $n_p$-$N_a$ - (X X X)$_i$-$N_b$-Y Y Y -$N_b$ - (Z Z Z)$_j$ -$N_a$ - $n_q$ 3' antisense:
3' $n_p$'-$N_a$'-(X'X'X')$_k$-$N_b$'-Y'Y'Y'-$N_b$'-(Z'Z'Z')$_l$-$N_a$'- $n_g$' 5' where:

j, k, and l are each independently 0 or 1;

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence including 0-25 nucleotides which are either modified or unmodified or combinations thereof, each sequence including at least two differently modified nucleotides;

each $N_b$ and $N_b$' independently represents an oligonucleotide sequence including 0-10 nucleotides which are either modified or unmodified or combinations thereof;

XXX, YYY, ZZZ, X'X'X', Y'Y'Y', and Z'Z'Z' each independently represent one motif of three identical modifications on three consecutive nucleotides, and where the modifications are 2'-O-methyl or 2'-fluoro modifications;

modifications on $N_b$ differ from the modification on Y and modifications on $N_b$' differ from the modification on Y';

where the sense strand includes at least one phosphorothioate linkage; and where the sense strand is conjugated to at least one ligand, optionally where the ligand is one or more lipophilic, e.g., C16, ligands.

Another aspect of the instant disclosure provides a double-stranded RNAi agent for inhibiting expression of an ATXN3 gene in a cell, where the double-stranded RNAi agent includes a sense strand complementary to an antisense strand, where the antisense strand includes a region complementary to part of an mRNA encoding ATXN3 (SEQ ID NO: 1), where each strand is about 14 to about 30 nucleotides in length, where the double-stranded RNAi agent is represented by formula (III):

(IIIa)

sense:
5' $n_p$-$N_a$ -Y Y Y - $N_a$ - $n_q$ 3' antisense:
3' $n_p$'-$N_a$'- Y'Y'Y'- $N_a$' - $n_q$' 5' where:

each $n_p$, $n_q$, and $n_q$', each of which may or may not be present, independently represents an overhang nucleotide;

p, q, and q' are each independently 0-6;

$n_p$'>0 and at least one $n_p$' is linked to a neighboring nucleotide via a phosphorothioate linkage;

each $N_a$ and $N_a$' independently represents an oligonucleotide sequence including 0-25 nucleotides which are either modified or unmodified or combinations thereof, each sequence including at least two differently modified nucleotides;

YYY and Y'Y'Y' each independently represent one motif of three identical modifications on three consecutive nucleotides, and where the modifications are 2'-O-methyl or 2'-fluoro modifications;

where the sense strand includes at least one phosphorothioate linkage; and where the sense strand is conjugated to at least one ligand, optionally where the ligand is one or more lipophilic, e.g., C16, ligands.

An additional aspect of the instant disclosure provides a double-stranded RNAi agent for inhibiting expression of an ATXN3 gene, where the double-stranded RNAi agent targeted to ATXN3 includes a sense strand and an antisense strand forming a double-stranded region, where the sense strand includes at least 15 contiguous nucleotides differing by no more than 3 nucleotides from any one of the nucleotide sequences of SEQ ID NOs: 1, 3, 5, and 7 and the antisense strand includes at least 15 contiguous nucleotides differing by no more than 3 nucleotides from any one of the nucleotide sequences of SEQ ID NOs: 2, 4, 6, and 8; where a substitution of a uracil for any thymine in the sequences provided in the SEQ ID NOs: 1-8 (when comparing aligned sequences) does not count as a difference that contributes to the differing by no more than 3 nucleotides from any one of the nucleotide sequences provided in SEQ ID NOs: 1-8, where substantially all of the nucleotides of the sense strand include a modification that is a 2'-O-methyl modification, a GNA or a 2'-fluoro modification, where the sense strand includes two phosphorothioate internucleotide linkages at the 5'-terminus, where substantially all of the nucleotides of the antisense strand include a modification selected from the group consisting of a 2'-O-methyl modification and a 2'-fluoro modification, where the antisense strand includes two phosphorothioate internucleotide linkages at the 5'-terminus and two phosphorothioate internucleotide linkages at the 3'-terminus, and where the sense strand is conjugated to one or more lipophilic, e.g., C16, ligands.

Another aspect of the instant disclosure provides a double-stranded RNAi agent for inhibiting expression of an ATXN3 gene, where the double-stranded RNAi agent targeted to ATXN3 includes a sense strand and an antisense strand forming a double-stranded region, where the sense strand includes at least 15 contiguous nucleotides differing by no more than 3 nucleotides from any one of the nucleotide sequences of SEQ ID NOs: 1, 3, 5, and 7 and the antisense strand includes at least 15 contiguous nucleotides differing by no more than 3 nucleotides from any one of the nucleotide sequences of SEQ ID NOs: 2, 4, 6, and 8, where a substitution of a uracil for any thymine in the sequences provided in the SEQ ID NOs: 1-8 (when comparing aligned sequences) does not count as a difference that contributes to the differing by no more than 3 nucleotides from any one of the nucleotide sequences provided in SEQ ID NOs: 1-8; where the sense strand includes at least one 3'-terminal deoxy-thymine nucleotide (dT), and where the antisense strand includes at least one 3'-terminal deoxy-thymine nucleotide (dT).

In one embodiment, all of the nucleotides of the sense strand and all of the nucleotides of the antisense strand are modified nucleotides.

In another embodiment, each strand has 19-30 nucleotides.

In certain embodiments, the antisense strand of the RNAi agent includes at least one thermally destabilizing modification of the duplex within the first 9 nucleotide positions of the 5'-region or a precursor thereof. Optionally, the thermally destabilizing modification of the duplex is one or more of -continued where B is nucleobase.

Another aspect of the instant disclosure provides a cell containing a double-stranded RNAi agent of the instant disclosure.

An additional aspect of the instant disclosure provides a pharmaceutical composition for inhibiting expression of an APP gene that includes a double-stranded RNAi agent of the instant disclosure.

In one embodiment, the double-stranded RNAi agent is administered in an unbuffered solution. Optionally, the unbuffered solution is saline or water.

In another embodiment, the double-stranded RNAi agent is administered with a buffer solution. Optionally, the buffer solution includes acetate, citrate, prolamine, carbonate, or phosphate or any combination thereof. In another embodiment, the buffer solution is phosphate buffered saline (PBS).

Another aspect of the disclosure provides a pharmaceutical composition that includes a double-stranded RNAi agent of the instant disclosure and a lipid formulation.

In one embodiment, the lipid formulation includes a lipid nanoparticle (LNP).

An additional aspect of the disclosure provides a method of inhibiting expression of an ATXN3 gene in a cell, the method involving: (a) contacting the cell with a double-stranded RNAi agent of the instant disclosure or a pharmaceutical composition of the instant disclosure; and (b) maintaining the cell produced in step (a) for a time sufficient to obtain degradation of the mRNA transcript of an ATXN3 gene, thereby inhibiting expression of the ATXN3 gene in the cell.

In one embodiment, the cell is within a subject. Optionally, the subject is a human.

In certain embodiments, the subject is a rhesus monkey, a cynomolgous monkey, a mouse, or a rat.

In certain embodiments, the human subject suffers from an ATXN3-associated disease, e.g., SCA3.

In certain embodiments ATXN3 expression is inhibited by at least about 50% by the RNAi agent.

Another aspect of the disclosure provides a method of treating a subject having a disorder that would benefit from a reduction in ATXN3 expression, e.g., SCA3, the method involving administering to the subject a therapeutically effective amount of a double-stranded RNAi agent of the disclosure or a pharmaceutical composition of the disclosure, thereby treating the subject.

In certain embodiments, the method further involves administering an additional therapeutic agent to the subject.

In certain embodiments, the double-stranded RNAi agent is administered at a dose of about 0.01 mg/kg to about 50 mg/kg.

In some embodiments, the double-stranded RNAi agent is administered to the subject intrathecally.

In one embodiment, the method reduces the expression of an ATXN3 gene in a brain or spine tissue. Optionally, the brain or spine tissue is cortex, cerebellum, dorsal root ganglia, substantia nigra, cerebellar dentate nucleus, pallidum, striatum, brainstem, thalamus, subthalamic, red, and pontine nuclei, cranial nerve nuclei and the anterior horn; and Clarke's column of the spinal cord cervical spine, lumbar spine, or thoracic spine. Other pathological studies have suggested that the extension of CNS degeneration in MJD patients at end stages may be more widespread, including the visual, auditory, vestibular, somatosensory, ingestion-related, dopaminergic and cholinergic systems (Rub et al., 2008).

Another aspect of the instant disclosure provides a method of inhibiting the expression of ATXN3 in a subject, the method involving: administering to the subject a therapeutically effective amount of a double-stranded RNAi agent of the disclosure or a pharmaceutical composition of the disclosure, thereby inhibiting the expression of ATXN3 in the subject.

An additional aspect of the disclosure provides a method for treating or preventing a disorder or ATXN3-associated disease or disorder in a subject, the method involving administering to the subject a therapeutically effective amount of a double-stranded RNAi agent of the disclosure or a pharmaceutical composition of the disclosure, thereby treating or preventing an ATXN3-associated disease or disorder in the subject.

In certain embodiments, the ATXN3-associated disease or disorder is SCA3.

Another aspect of the instant disclosure provides a kit for performing a method of the instant disclosure, the kit including: a) a double-stranded RNAi agent of the instant disclosure, and b) instructions for use, and c) optionally, a device for administering the double-stranded RNAi agent to the subject.

An additional aspect of the instant disclosure provides a double-stranded ribonucleic acid (RNAi) agent for inhibiting expression of an ataxin3 (ATXN3) gene, where the RNAi agent possesses a sense strand and an antisense strand, and where the antisense strand includes a region of complementarity which includes at least 15 contiguous nucleotides differing by no more than 3 nucleotides, e.g., at least 15 nucleotides, at least 19 nucleotides, from any one of the antisense strand nucleobase sequences of Tables 2, 4A, 4B, 5, 7A, 7B, 10, 11, and 14. In one embodiment, the RNAi agent includes one or more of the following modifications: a 2'-O-methyl modified nucleotide, a 2'-fluoro modified nucleotide, a 2'-C-alkyl-modified nucleotide, a nucleotide comprising a glycol nucleic acid (GNA), a phosphorothioate (PS), and a vinyl phosphonate (VP). Optionally, the RNAi agent includes at least one of each of the following modifications: a 2'-O-methyl modified nucleotide, a 2'-fluoro modified nucleotide, a 2'-C-alkyl-modified nucleotide, a nucleotide comprising a glycol nucleic acid (GNA), a phosphorothioate, and a vinyl phosphonate (VP).

In another embodiment, the RNAi agent includes four or more PS modifications, optionally six to ten PS modifications, optionally eight PS modifications.

In an additional embodiment, each of the sense strand and the antisense strand of the RNAi agent possesses a 5'-terminus and a 3'-terminus, and the RNAi agent includes eight PS modifications positioned at each of the penultimate and ultimate internucleotide linkages from the respective 3'- and 5'-termini of each of the sense and antisense strands of the RNAi agent.

In another embodiment, each of the sense strand and the antisense strand of the RNAi agent includes a 5'-terminus and a 3'-terminus, and the RNAi agent includes only one nucleotide including a GNA. Optionally, the nucleotide including a GNA is positioned on the antisense strand at the seventh nucleobase residue from the 5'-terminus of the antisense strand.

In an additional embodiment, each of the sense strand and the antisense strand of the RNAi agent includes a 5'-terminus and a 3'-terminus, and the RNAi agent includes one to four 2'-C-alkyl-modified nucleotides. Optionally, the 2'-C-alkyl-modified nucleotide is a 2'-C16-modified nucleotide. Optionally, the RNAi agent includes a single 2'-C-alkyl, e.g., C16-modified nucleotide. Optionally, the single 2'-C-alkyl, e.g., C16-modified nucleotide is located on the sense strand at the sixth nucleobase position from the 5'-terminus of the sense strand.

In another embodiment, each of the sense strand and the antisense strand of the RNAi agent includes a 5'-terminus and a 3'-terminus, and the RNAi agent includes two or more 2'-fluoro modified nucleotides. Optionally, each of the sense strand and the antisense strand of the RNAi agent includes two or more 2'-fluoro modified nucleotides. Optionally, the 2'-fluoro modified nucleotides are located on the sense strand at nucleobase positions 7, 9, 10, and 11 from the 5'-terminus of the sense strand and on the antisense strand at nucleobase positions 2, 14, and 16 from the 5'-terminus of the antisense strand.

In an additional embodiment, each of the sense strand and the antisense strand of the RNAi agent includes a 5'-terminus and a 3'-terminus, and the RNAi agent includes one or more VP modifications. Optionally, the RNAi agent includes a single VP modification at the 5'-terminus of the antisense strand.

In another embodiment, each of the sense strand and the antisense strand of the RNAi agent includes a 5'-terminus and a 3'-terminus, and the RNAi agent includes two or more 2'-O-methyl modified nucleotides. Optionally, the RNAi agent includes 2'-O-methyl modified nucleotides at all nucleobase locations not modified by a 2'-fluoro, a 2'-C- alkyl or a glycol nucleic acid (GNA). Optionally, the two or more 2'-O-methyl modified nucleotides are located on the sense strand at positions 1, 2, 3, 4, 5, 8, 12, 13, 14, 15, 16, 17, 18, 19, 20, and 21 from the 5'-terminus of the sense strand and on the antisense strand at positions 1, 3, 4, 5, 6, 8, 9, 10, 11, 12, 13, 15, 17, 18, 19, 20, 21, 22, and 23 from the 5'-terminus of the antisense strand.

BRIEF DESCRIPTION OF THE DRAWINGS

FIG. 1 depicts the sequences and chemistry of the exemplary ATXN3 siRNAs, including AD-1103843, AD-1069823, AD-414356, AD-1069828, AD-1069829, AD-1069830, AD-1041266, AD-368995, and AD-368996 (corresponding to the duplex sequences in Table 10). For each siRNA, "F" is the "2'-fluoro" modification, OMe is a methoxy group, GNA refers to a glycol nucleic acid, 2-C16 refers to the targeting ligand, and PS refers to the phosphorothiolate linkage.

DETAILED DESCRIPTION OF THE INVENTION

Figure 2:
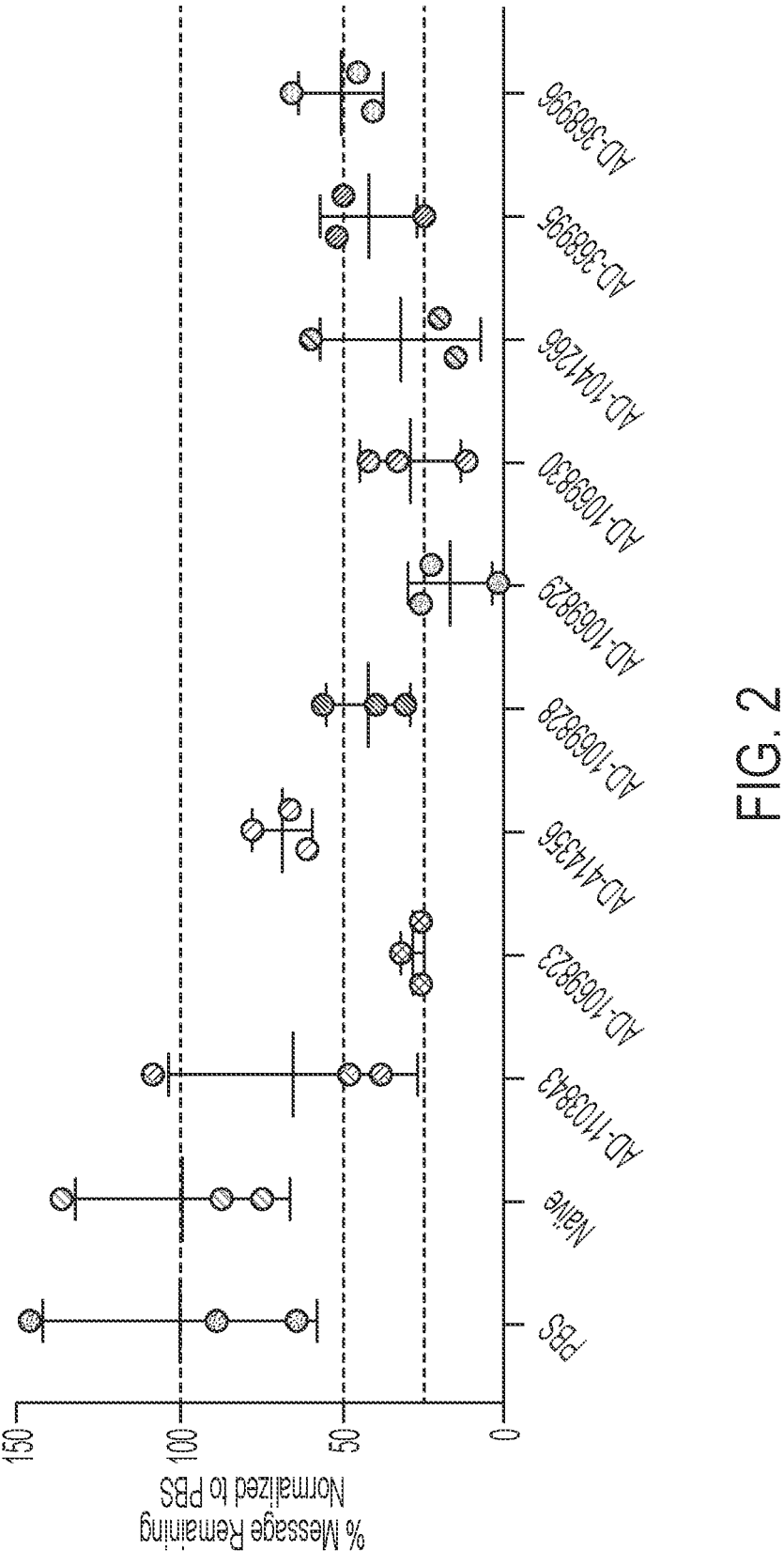
FIG. 2 is a graph depicting the percent ATXN3 message remaining normalized to PBS in mice on day 14 post-treatment with the exemplary duplexes indicated on the X-axis (from left to right: PBS control; naïve, non-injected control, AD-1103843, AD-1069823, AD-414356, AD-1069828, AD-1069829, AD-1069830, AD-1041266, AD-368995, and AD-368996).

The present disclosure provides RNAi compositions, which effect the RNA-induced silencing complex (RISC)-mediated cleavage of RNA transcripts of an ATXN3 gene. The ATXN3 gene may be within a cell, e.g., a cell within a subject, such as a human. The present disclosure also provides methods of using the RNAi compositions of the disclosure for inhibiting the expression of an ATXN3 gene or for treating a subject having a disorder that would benefit from inhibiting or reducing the expression of an ATXN3 gene, e.g., an ATXN3-associated disease, for example, SCA3.

The RNAi agents of the disclosure include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an ATXN3 gene. In certain embodiments, the RNAi agents of the disclosure include an RNA strand (the antisense strand) having a region which is about 21-23 nucleotides in length, which region is substantially complementary to at least part of an mRNA transcript of an ATXN3 gene, i.e., no more than two mismatches from the target gene within the region wherein the antisense strand is complementary to the ATXN3 mRNA. In certain embodiments, the RNAi agents of the disclosure include an RNA strand (the antisense strand) having a region which is about 21-23 nucleotides in length, which region is fully complementary to at least part of an mRNA transcript of an ATXN3 gene.

In certain embodiments, the RNAi agents of the disclosure include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of an ATXN3 gene. These RNAi agents with the longer length antisense strands preferably include a second RNA strand (the sense strand) of 20-60 nucleotides in length wherein the sense and antisense strands form a duplex of 18-30 contiguous nucleotides.

The use of these RNAi agents enables the targeted degradation of mRNAs of an ATXN3 gene in mammals. Using cell-based assays, the present inventors have demonstrated that RNAi agents targeting ATXN3 can mediate RNAi, resulting in significant inhibition of expression of an ATXN3 gene. Thus, methods and compositions including these RNAi agents are useful for treating a subject who would benefit by a reduction in the levels or activity of an ATXN3 protein, such as a subject having an ATXN3-associated disease, for example, SCA3.

The following detailed description discloses how to make and use compositions containing RNAi agents to inhibit the expression of an ATXN3 gene, as well as compositions and methods for treating subjects having diseases and disorders that would benefit from inhibition or reduction of the expression of the genes.

I. Definitions

In order that the present disclosure may be more readily understood, certain terms are first defined. In addition, it should be noted that whenever a value or range of values of a parameter are recited, it is intended that values and ranges intermediate to the recited values are also intended to be part of this disclosure.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to". The term "or" is used herein to mean, and is used interchangeably with, the term "and/or," unless context clearly indicates otherwise.

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range.

As used herein, "or" is understood as "and/or" unless context dictates otherwise.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a chemical structure and a chemical name, the chemical structure takes precedence.

The term "ataxin3" or "ATXN3", also known as AT3; JOS; MJD; ATX3; MJD1; SCA3, refers to a gene associated with Machado-Joseph disease, also known as spinocerebellar ataxia-3, is an autosomal dominant neurologic disorder. The protein encoded by this gene contains (CAG) n repeats in the coding region, and the expansion of these repeats from the normal 12-44 to 52-86 is one cause of Machado-Joseph disease ("12-44" and "52-86" (CAG) n repeats disclosed as SEQ ID NOS 1920-1921, respectively). There is a negative correlation between the age of onset and CAG repeat numbers. Alternatively spliced transcript variants encoding different isoforms have been described for this gene. Nucleotide and amino acid sequences of ATXN3 can be found, for example, at GenBank Accession No. NM_001127697.2 (Homo sapiens ATXN3, SEQ ID NO: 1, reverse complement, SEQ ID NO: 2); GenBank Accession No.: XM_005595835.1 (Macaca fascicularis ATXN3, SEQ ID NO: 3, reverse complement, SEQ ID NO: 4); GenBank Accession No. NM_029705.3 (Mus musculus ATXN3, SEQ ID NO: 5; reverse complement, SEQ ID NO: 6); and GenBank Accession No.: XM_006240493.3 (Rattus norvegicus ATXN3, SEQ ID NO: 7, reverse complement, SEQ ID NO: 8). Additional examples of ATXN3 sequences can be found in publically available databases, for example, GenBank, OMIM, and UniProt. Additional information on ATXN3 can be found, for example, at www.ncbi.nlm.nih.gov/gene/4287.

The term ATXN3 as used herein also refers to variations of the ATXN3 gene including variants provided in the SNP database, for example, at www.ncbi.nlm.nih.gov/snp?LinkName=gene_snp&from_uid=4287.

As used herein, "target sequence" refers to a contiguous portion of the nucleotide sequence of an mRNA molecule formed during the transcription of an ATXN3 gene, including mRNA that is a product of RNA processing of a primary transcription product. In one embodiment, the target portion of the sequence will be at least long enough to serve as a substrate for RNAi-directed cleavage at or near that portion of the nucleotide sequence of an mRNA molecule formed during the transcription of an ATXN3 gene.

The target sequence is about 15-30 nucleotides in length. For example, the target sequence can be about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In certain embodiments, the target sequence is 19-23 nucleotides in length, optionally 21-23 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature.

"G," "C," "A," "T", and "U" each generally stand for a nucleotide that contains guanine, cytosine, adenine, thymidine, and uracil as a base, respectively in the context of a modified or unmodified nucleotide. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, thymidine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the disclosure by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the disclosure.

The terms "iRNA", "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. RNA interference (RNAi) is a process that directs the sequence-specific degradation of mRNA. RNAi modulates, e.g., inhibits, the expression of ATXN3 in a cell, e.g., a cell within a subject, such as a mammalian subject.

In one embodiment, an RNAi agent of the disclosure includes a single stranded RNAi that interacts with a target RNA sequence, e.g., an ATXN3 target mRNA sequence, to direct the cleavage of the target RNA. Without wishing to be bound by theory it is believed that long double-stranded RNA introduced into cells is broken down into double-stranded short interfering RNAs (siRNAs) comprising a sense strand and an antisense strand by a Type III endonuclease known as Dicer (Sharp et al. (2001) Genes Dev. 15:485). Dicer, a ribonuclease-III-like enzyme, processes these dsRNA into 19-23 base pair short interfering RNAs with characteristic two base 3'-overhangs (Bernstein, et al., (2001) Nature 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the disclosure relates to a single stranded RNA (ssRNA) (the antisense strand of a siRNA duplex) generated within a cell and which promotes the formation of a RISC complex to effect silencing of the target gene, i.e., an ATXN3 gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, a "RNAi agent" for use in the compositions and methods of the disclosure is a double-stranded RNA and is referred to herein as a "double-stranded RNAi agent," "double-stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., an ATXN3 gene. In some embodiments of the disclosure, a double-stranded RNA (dsRNA) triggers the degradation of a target RNA, e.g., an mRNA, through a post-transcriptional gene-silencing mechanism referred to herein as RNA interference or RNAi.

In general, a dsRNA molecule can include ribonucleotides, but as described in detail herein, each or both strands can also include one or more non-ribonucleotides, e.g., a deoxyribonucleotide, or other modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the disclosure include all types of modifications disclosed herein or known in the art. Any such modifications, as used in a siRNA type molecule, are encompassed by "RNAi agent" for the purposes of this specification and claims.

In certain embodiments of the instant disclosure, inclusion of a deoxy-nucleotide—which is acknowledged as a naturally occurring form of nucleotide—if present within a RNAi agent can be considered to constitute a modified nucleotide.

The duplex region may be of any length that permits specific degradation of a desired target RNA through a RISC pathway, and are about 15-36 base pairs in length, for example, about 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 4, at least 5, at least 6, at least 7, at least 8, at least 9, at least 10, at least 20, at least 23 or more unpaired nucleotides or nucleotides not directed to the target site of the dsRNA. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not, but can be covalently connected. In certain embodiments where the two strands are connected covalently by means other than an uninterrupted chain of nucleotides between the 3'-end of one strand and the 5'-end of the respective other strand forming the duplex structure, the connecting structure is referred to as a "linker" (though it is noted that certain other structures defined elsewhere herein can also be referred to as a "linker"). The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3'-overhang of at least 1 nucleotide. In another embodiment, at least one strand comprises a 3'-overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5'-overhang of at least 1 nucleotide. In certain embodiments, at least one strand comprises a 5'-overhang of at least 2 nucleotides, e.g., 2, 3, 4, 5, 6, 7, 9, 10, 11, 12, 13, 14, or 15 nucleotides. In still other embodiments, both the 3'- and the 5'-end of one strand of the RNAi agent comprise an overhang of at least 1 nucleotide.

In one embodiment, an RNAi agent of the disclosure is a dsRNA, each strand of which independently has 19-23 nucleotides, that interacts with a target RNA sequence, e.g., an ATXN3 target mRNA sequence, to direct the cleavage of the target RNA.

As used herein, the term "nucleotide overhang" refers to at least one unpaired nucleotide that protrudes from the duplex structure of a RNAi agent, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the overhang on the sense strand or the antisense strand, can include extended lengths longer than 10 nucleotides, e.g., 10-30 nucleotides, 12-30 nucleotides, 10-20 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

The term "antisense strand" or "guide strand" refers to the strand of a RNAi agent, e.g., a dsRNA, which includes a region that is substantially complementary to a target sequence, e.g., an ATXN3 mRNA.

As used herein, the term "region of complementarity" refers to the region on the antisense strand that is substantially complementary to a sequence, for example a target sequence, e.g., an ATXN3 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- or 3'-terminus of the RNAi agent.

The term "sense strand" or "passenger strand" as used herein, refers to the strand of a RNAi agent that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person.

Complementary sequences within a RNAi agent, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or preferably no more than 2 mismatched base pairs upon hybridization for a duplex up to 30 base pairs, while retaining the ability to hybridize under the conditions most relevant to their ultimate application, e.g., inhibition of gene expression via a RISC pathway. In certain embodiments, the mismatches are not present in the seed region. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of a RNAi agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding ATXN3). For example, a polynucleotide is complementary to at least a part of an ATXN3 mRNA if the sequence is substantially complementary to a non-interrupted portion of an mRNA encoding ATXN3.

Accordingly, in some embodiments, the antisense strand polynucleotides disclosed herein are fully complementary to the target ATXN3 sequence. In other embodiments, the antisense strand polynucleotides disclosed herein are substantially complementary to the target ATXN3 sequence and comprise a contiguous nucleotide sequence which is at least about 80% complementary over its entire length to the equivalent region of the nucleotide sequence of SEQ ID NOs: 1, 3, 5, or 7 for ATXN3, or a fragment of SEQ ID NOs: 1, 3, 5, or 7 for ATXN3, such as about 85%, about 90%, about 95%, or about 99% complementary.

In other embodiments, the antisense polynucleotides disclosed herein are substantially complementary to the target ATXN3 sequence and comprise a contiguous nucleotide sequence which is at least about 80% complementary over its entire length to any one of the sense strand nucleotide sequences in any one of any one of Tables 2, 4A, 4B, 5, 7A, 7B, 10, 11, and 14 for ATXN3, or a fragment of any one of the sense strand nucleotide sequences in any one of Tables 2, 4A, 4B, 5, 7A, 7B, 10, 11, and 14 for ATXN3, such as about 85%, about 90%, about 95%, or about 99% complementary.

In one embodiment, an RNAi agent of the disclosure includes a sense strand that is substantially complementary to an antisense polynucleotide which, in turn, is the same as a target ATXN3 sequence, and wherein the sense strand polynucleotide comprises a contiguous nucleotide sequence which is at least about 80% complementary over its entire length to the equivalent region of the nucleotide sequence of SEQ ID NOs: 2, 4, 6, or 8, or a fragment of any one of SEQ ID NOs: 2, 4, 6, or 8, such as about 85%, 90%, about 95%, or about 99% complementary.

In one embodiment, at least partial suppression of the expression of an ATXN3 gene, is assessed by a reduction of the amount of ATXN3 mRNA which can be isolated from or detected in a first cell or group of cells in which an ATXN3 gene is transcribed and which has or have been treated such that the expression of an ATXN3 gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an RNAi agent," such as a dsRNA, as used herein, includes contacting a cell by any possible means. Contacting a cell with an RNAi agent includes contacting a cell in vitro with the RNAi agent or contacting a cell in vivo with the RNAi agent. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the central nervous system (CNS), optionally via intrathecal, intravitreal, or other injection, or to the bloodstream or the subcutaneous space, such that the agent will subsequently reach the tissue where the cell to be contacted is located. For example, the RNAi agent may contain or be coupled to a ligand, e.g., a lipophilic moiety or moieties as described below and further detailed, e.g., in WO/2019/217459 which is incorporated herein by reference, that directs or otherwise stabilizes the RNAi agent at a site of interest, e.g., the CNS. Combinations of in vitro and in vivo methods of contacting are also possible. For example, a cell may also be contacted in vitro with an RNAi agent and subsequently transplanted into a subject.

In one embodiment, contacting a cell with a RNAi agent includes "introducing" or "delivering the RNAi agent into the cell" by facilitating or effecting uptake or absorption into the cell. Absorption or uptake of a RNAi agent can occur through unaided diffusive or active cellular processes, or by auxiliary agents or devices. Introducing a RNAi agent into a cell may be in vitro or in vivo. For example, for in vivo introduction, a RNAi agent can be injected into a tissue site or administered systemically. In vitro introduction into a cell includes methods known in the art such as electroporation and lipofection. Further approaches are described herein below or are known in the art.

The term "lipophile" or "lipophilic moiety" broadly refers to any compound or chemical moiety having an affinity for lipids. One way to characterize the lipophilicity of the lipophilic moiety is by the octanol-water partition coefficient, log $K_{ow}$, where $K_{ow}$ is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., *J. Chem. Inf. Comput. Sci.* 41:1407-21 (2001), which is incorporated herein by reference in its entirety). It provides a thermodynamic measure of the tendency of the substance to prefer a non-aqueous or oily milieu rather than water (i.e. its hydrophilic/lipophilic balance). In principle, a chemical substance is lipophilic in character when its log $K_{ow}$ exceeds 0. Typically, the lipophilic moiety possesses a log $K_{ow}$ exceeding 1, exceeding 1.5, exceeding 2, exceeding 3, exceeding 4, exceeding 5, or exceeding 10. For instance, the log $K_{ow}$ of 6-amino hexanol, for instance, is predicted to be approximately 0.7. Using the same method, the log $K_{ow}$ of cholesteryl N-(hexan-6-ol) carbamate is predicted to be 10.7.

The lipophilicity of a molecule can change with respect to the functional group it carries. For instance, adding a hydroxyl group or amine group to the end of a lipophilic moiety can increase or decrease the partition coefficient (e.g., log $K_{ow}$) value of the lipophilic moiety.

Alternatively, the hydrophobicity of the double-stranded RNAi agent, conjugated to one or more lipophilic moieties, can be measured by its protein binding characteristics. For instance, in certain embodiments, the unbound fraction in the plasma protein binding assay of the double-stranded RNAi agent could be determined to positively correlate to the relative hydrophobicity of the double-stranded RNAi agent, which could then positively correlate to the silencing activity of the double-stranded RNAi agent.

In one embodiment, the plasma protein binding assay determined is an electrophoretic mobility shift assay (EMSA) using human serum albumin protein. An exemplary protocol of this binding assay is illustrated in detail in, e.g., WO/2019/217459. The hydrophobicity of the double-stranded RNAi agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded RNAi agent provides optimal hydrophobicity for the enhanced in vivo delivery of siRNA.

The term "lipid nanoparticle" or "LNP" is a vesicle comprising a lipid layer encapsulating a pharmaceutically active molecule, such as a nucleic acid molecule, e.g., a rNAi agent or a plasmid from which a RNAi agent is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), or a non-primate (such as a rat, or a mouse). In a preferred embodiment, the subject is a human, such as a human being treated or assessed for a disease, disorder, or condition that would benefit from reduction in ATXN3 expression; a human at risk for a disease, disorder, or condition that would benefit from reduction in ATXN3 expression; a human having a disease, disorder, or condition that would benefit from reduction in ATXN3 expression; or a human being treated for a disease, disorder, or condition that would benefit from reduction in ATXN3 expression as described herein.

As used herein, the terms "treating" or "treatment" refer to a beneficial or desired result including, but not limited to, alleviation or amelioration of one or more signs or symptoms associated with ATXN3 gene expression or ATXN3 protein production, e.g., ATXN3-associated diseases such as SCA3. "Treatment" can also mean prolonging survival as compared to expected survival in the absence of treatment.

The term "lower" in the context of the level of ATXN3 in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of ATXN3 in a subject is preferably down to a level accepted as within the range of normal for an individual without such disorder. In certain embodiments, "lower" is the decrease in the difference between the level of a marker or symptom for a subject suffering from a disease and a level accepted within the range of normal for an individual, e.g., the level of decrease in body weight between an obese individual and an individual having a weight accepted within the range of normal. As used herein, lowering can refer to lowering or predominantly lowering an ATXN3 with a trinucleotide expansion.

As used herein, "prevention" or "preventing," when used in reference to a disease, disorder, or condition thereof, that would benefit from a reduction in expression of an ATXN3 gene or production of an ATXN3 protein, refers to a reduction in the likelihood that a subject will develop or increase the age at which a symptom associated with such a disease, disorder, or condition, e.g., a symptom of SCA3 in a subject that does not yet meet any of the diagnostic criteria other than the presence of the trinucleotide repeat expansion in the ATXN3 gene. It is well understood that SCA3 is nearly fully penetrant and that the length of the repeat expansion is inversely correlated with the age of onset and the severity of disease. Thus, it is within the ability of one of skill in the art to predict the course that a disease will take in an individual based on genotype and what would constitute a delay in onset or decrease in severity of SCA3. The failure to develop a disease, disorder, or condition, or the reduction in the development of a symptom associated with such a disease, disorder, or condition (e.g., by at least 10% on a clinically accepted scale for that disease or disorder), or the exhibition of delayed symptoms delayed (e.g., by days, weeks, months, or years) is considered effective prevention.

As used herein, the term "Spinocerebellar ataxias (SCAs)" is a disease or disorder that is caused by, or associated with, a mutation in an SCA gene. Spinocerebellar ataxias (SCAs) describe a large group of neurodegenerative disorders that affect movement, with more than 40 autosomal dominant SCAs described. The disorders are characterized progressive degeneration of the cerebellum and spinal motor neurons, however both the affected brain regions and the clinical features of SCAs vary depending on the subtype. In all types, ataxia is the key feature, manifested by signs including dysfunction of motor coordination affecting gait, balance, and speech. Signs and symptoms further include, but are not limited to, initially predominantly cerebellar neuronal degeneration, followed by neuronal degeneration in the brainstem, pyramidal and extrapyramidal neurons, oculomotor system, lower motor neurons, and peripheral nerves. Oculomotor symptoms include progressive external ophthalmoplegia (weakness of the eye muscles) and diplopia (double vision), the pyramidal symptoms include spasticity, hyperreflexia, and weakness, extrapyramidal symptoms include dystonia (continuous spasms and muscle contractions), tremors, bradykinesia (slowness of movement), and other symptoms that may resemble Parkinson's disease.

As used herein, the term "ATXN3-associated disease" or "ATXN3-associated disorder" is understood as SCA3. Spinocerebellar ataxia type 3 (SCA3), also known as Machado-Joseph Disease (MJD), is caused by an expansion of trinucleotide (CAG) repeats in the coding region of Ataxin 3 (ATXN3) which encode poly-glutamine (polyQ) amino acid expansions in ATXN3 protein with SCA3-affected individuals have approximately 52-86 repeats and with the length of the expansion is correlated to the severity of the disease and inversely correlated with the age of onset. Symptoms of SCA3 include, but are not limited to, pyramidal and extrapyramidal symptoms that include spasticity, rigidity, and bradykinesia; ataxia, dysarthria, and spastic paraplegia; peripheral polyneuropathy; dopa-responsive parkinsonism, irrespective of the age of onset or progression; and on an anatomical level, SCA3 shows substantial loss of neurons in the dentate nucleus and substantia nigra, while the cortex of the cerebellum may be largely spared.

"Therapeutically effective amount," as used herein, is intended to include the amount of an RNAi agent that, when administered to a subject having an ATXN3-associated disorder, is sufficient to effect treatment of the disease (e.g., by ameliorating or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of a RNAi agent that, when administered to a subject having an ATXN3-associated disorder, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of a RNAi agent that produces some desired local or systemic effect at a reasonable benefit/risk ratio applicable to any treatment. A RNAi agent employed in the methods of the present disclosure may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates or polyanhydrides; (22) bulking agents, such as polypeptides and amino acids (23) serum component, such as serum albumin, HDL and LDL; and (22) other non-toxic compatible substances employed in pharmaceutical formulations. As used herein, carriers acceptable for administration of an RNAi agent into the CNS by injection is preferred.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the brain (e.g., whole brain or certain segments of brain or certain types of cells in the brain, such as, e.g., neurons and glial cells (astrocytes, oligodendrocytes, microglial cells)). In some embodiments, a "sample derived from a subject" refers to blood drawn from the subject or plasma or serum derived therefrom. In further embodiments, a "sample derived from a subject" refers to brain tissue (or subcomponents thereof) or retinal tissue (or subcomponents thereof) derived from the subject.

II. RNAi Agents of the Disclosure

Described herein are RNAi agents which inhibit the expression of an ATXN3 gene. In one embodiment, the RNAi agent includes double-stranded ribonucleic acid (dsRNA) molecules for inhibiting the expression of an ATXN3 gene in a cell, such as a cell within a subject, e.g., a mammal, such as a human having an ATXN3-associated disorder, e.g., SCA3. The dsRNA includes an antisense strand having a region of complementarity which is complementary to at least a part of an mRNA formed in the expression of an ATXN3 gene, The region of complementarity is about 15-30 nucleotides in length. Upon contact with a cell expressing the ATXN3 gene, the RNAi agent inhibits the expression of the ATXN3 gene (e.g., a human gene, a primate gene, a non-primate gene) by at least 50% as assayed by, for example, a PCR or branched DNA (bDNA)-based method, or by a protein-based method, such as by immunofluorescence analysis, using, for example, western blotting or flowcytometric techniques. In a preferred embodiment, the level of knockdown is assayed at a 10 nM concentration of siRNA human Be(2)c cells using the PCR method provided in the Examples below.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an ATXN3 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity of the antisense strand of the RNAi agent to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, each strand of the RNAi agent is independently 15 to 23 nucleotides in length, or 25 to 30 nucleotides in length. In general, the dsRNA is long enough to serve as a substrate for the Dicer enzyme. For example, it is well known in the art that dsRNAs longer than about 21-23 nucleotides can serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 15 to 36 base pairs, e.g., 15-36, 15-35, 15-34, 15-33, 15-32, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs, for example, 19-21 base pairs. Thus, in one embodiment, to the extent that it becomes processed to a functional duplex that targets a desired RNA for cleavage. Thus, an ordinarily skilled artisan will recognize that in one embodiment, a miRNA is a dsRNA. In another embodiment, a dsRNA is not a naturally occurring miRNA. In another embodiment, a RNAi agent useful to target ATXN3 expression is not generated in the target cell by cleavage of a larger dsRNA.

A dsRNA as described herein can further include one or more single-stranded nucleotide overhangs e.g., 1, 2, 3, or 4 nucleotides. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art.

In one aspect, a dsRNA of the disclosure includes at least two nucleotide sequences, a sense sequence and an antisense sequence. The sense strand sequence for ATXN3 may be selected from the group of sequences provided in any one of Tables 2, 4A, 4B, 5, 7A, 7B, 10, 11, and 14, and the corresponding nucleotide sequence of the antisense strand of the sense strand may be selected from the group of sequences of any one of Tables 2, 4A, 4B, 5, 7A, 7B, 10, 11, and 14. In this aspect, one of the two sequences is complementary to the other of the two sequences, with one of the sequences being substantially complementary to a sequence of an mRNA generated in the expression of an ATXN3 gene. As such, in this aspect, a dsRNA will include two oligonucleotides, where one oligonucleotide is described as the sense strand (passenger strand) in any one of Tables 2, 4A, 4B, 5, 7A, 7B, 10, 11, and 14, and the second oligonucleotide is described as the corresponding antisense strand (guide strand) of the sense strand in any one of Tables 2, 4A, 4B, 5, 7A, 7B, 10, 11, and 14 for ATXN3. Accordingly, by way of example, the nucleotide sequences of the following pairwise selections of sense and antisense strand sequences are expressly contemplated as forming duplexes of the instant disclosure: duplexes AD-368996 (GCG-GUUUGCAAACAAAAUGAU (SEQ ID NO: 749) and AUCAUUUGUUUGCAAACCGCUA (SEQ ID NO: 885)), AD-369082 (GCAUUCAGCAAUUAAAGACAU (SEQ ID NO: 752) and AUGUCUTU-AAUUGCUGAAUGCCU (SEQ ID NO: 888)), AD-414322 (UCGACCAAAACUUAUUGGAGA (SEQ ID NO: 837) and UCUCCAAUAAGUUUUGGUCGAUG (SEQ ID NO: 973)), AD-368337 (AGGAAGGUUAUUCUAUAUUUG (SEQ ID NO: 724) and CAAAUAUAGAAUAACCUUC-CUGU (SEQ ID NO: 860)), AD-368871 (UGUCUUUA-GAAACUGUCAGAA (SEQ ID NO: 740) and UUCUGACAGUUUCUAAAGACAUG (SEQ ID NO: 876)), and AD-368815 (GAGUGAUCUAGGUGAUGC-UAU (SEQ ID NO: 735) and AUAGCATCACCUAGAU-CACUCCC (SEQ ID NO: 871)), AD-368996 (GCG-GUUUGCAAACAAAAUGAU (SEQ ID NO: 749) and AUCAUUUGUUUGCAAACCGCUA (SEQ ID NO: 885)), AD-1041266 (GAGGCAUUCAGCAAUUAAAGA (SEQ ID NO: 1806) and UCUUUAAUUGCUGAAUGC-CUCUU (SEQ ID NO: 1865)), AD-414356 (AUG-CAUCGACCAAAACUUAUA (SEQ ID NO: 1026) and UAUAAGUUUUGGUCGAUGCAUCU (SEQ ID NO: 1120)), AD-1103843 (GAGUGAUCUAGGUGAUGCUAA (SEQ ID NO: 1852) and UUAGCATCACCUAGAUCA-CUCCC (SEQ ID NO: 1911)), AD-1069823 (AGGAAG-GUUAUUCUAUAUUUA (SEQ ID NO: 1835) and UAAAUAUAGAAUAACCUUCCUGU (SEQ ID NO: 1894)), AD-1069828 (UGUCUUUAGAAACUGUCAGAA (SEQ ID NO: 1840) and UUCUGACAGUUUCUAAAGA-CAUG (SEQ ID NO: 1899)), AD-1069829 (UUUUAGCG-GUUUGCAAACAAA (SEQ ID NO: 1841) and UUU-GUUUGCAAACCGCUAAAAGU (SEQ ID NO: 1900)), and AD-1069830 (GCGGUUUGCAAACAAAAUGAA (SEQ ID NO: 1842) and UUCAUUUU-GUUUGCAAACCGCUA (SEQ ID NO: 1901)). Further, the by way of example, the following pairwise selections of chemically modified sense and antisense strand sequences are expressly considered as forming duplexes of the instant disclosure: duplexes AD-368996, AD-369082, AD-414322, AD-368337, AD-368871, and AD-368815 as provided in Table 2, either with or without the L96 ligand; or AD-368996, AD-369082, AD-414322, AD-368337, AD-368871, and AD-368815 as provided in Table 5, wherein the C16 modification, or other lipid modification, may be in the position shown or at another position in the sense or antisense strand as discussed herein. Similarly, pairwise combinations of sense and antisense strands targeted to ATXN3 of Tables 2, 4A, 4B, 5, 7A, 7B, 10, 11, and 14 of the instant disclosure are also expressly contemplated.

In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in Tables 2, 5, 7A, 10, 11, and 14 are described as modified or conjugated sequences, the RNA of the RNAi agent of the disclosure e.g., a dsRNA of the disclosure, may comprise any one of the sequences set forth in any one of Table 2, 4A, 4B, 5, 7A, 7B, 10, 11, and 14 that is un-modified, un-conjugated, or modified or conjugated differently than described therein. That is, the modified sequences provided in Tables 2, 7A, 10, and 11 do not require the L96 ligand, or any ligand. Similarly, the exemplary modified sequences provided in Table 5 or Table 14 do not require the exemplary C16 lipophilic ligand shown, or a lipophilic ligand in the position shown. A lipophilic ligand can be included in any of the positions provided in the instant application.

The skilled person is well aware that dsRNAs having a duplex structure of about 20 to 23 base pairs, e.g., 21, base pairs have been hailed as particularly effective in inducing RNA interference (Elbashir et al., (2001) *EMBO J.,* 20:6877-6888). However, others have found that shorter or longer RNA duplex structures can also be effective (Chu and Rana (2007) RNA 14:1714-1719; Kim et al. (2005) *Nat Biotech* 23:222-226), US20050244858, and US20100173973. In the embodiments described above, by virtue of the nature of the oligonucleotide sequences provided herein, dsRNAs described herein can include at least one strand of a length of minimally 21 nucleotides. It can be reasonably expected that shorter duplexes minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of an ATXN3 gene by not more than 10, 15, 20, 25, or 30% inhibition from a dsRNA comprising the full sequence using the in vitro assay with human Be(2)c and a 10 nM concentration of the RNA agent and the PCR assay as provided in the examples herein, are contemplated to be within the scope of the present disclosure.

In addition, the RNAs described herein identify a site(s) in an ATXN3 transcript that is susceptible to RISC-mediated cleavage. As such, the present disclosure further features RNAi agents that target within this site(s). As used herein, a RNAi agent is said to target within a particular site of an RNA transcript if the RNAi agent promotes cleavage of the transcript anywhere within that particular site. Such a RNAi agent will generally include at least about 15 contiguous nucleotides, preferably at least 19 contiguous nucleotides, from one of the sequences provided herein coupled to additional nucleotide sequences taken from the region contiguous to the selected sequence in an ATXN3 gene.

A RNAi agent as described herein can contain one or more mismatches to the target sequence. In one embodiment, a RNAi agent as described herein contains no more than 3 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide antisense strand of an RNAi agent, the strand which is complementary to a region of an ATXN3 gene, generally does not contain any mismatch within the central 13 nucleotides or within the seed region. The methods described herein or methods known in the art can be used to determine whether a RNAi agent containing a mismatch to a target sequence is effective in inhibiting the expression of an ATXN3 gene. Consideration of the efficacy of RNAi agents with mismatches in inhibiting expression of an ATXN3 gene is important, especially if the particular region of complementarity in an ATXN3 gene is known to have polymorphic sequence variation within the population.

III. Modified RNAi Agents of the Disclosure

In one embodiment, the RNA of the RNAi agent of the disclosure e.g., a dsRNA, is un-modified, and does not comprise, e.g., chemical modifications or conjugations known in the art and described herein. In preferred embodiments, the RNA of a RNAi agent of the disclosure, e.g., a dsRNA, is chemically modified to enhance stability or other beneficial characteristics. In certain embodiments of the disclosure, substantially all of the nucleotides of a RNAi agent of the disclosure are modified. In other embodiments of the disclosure, all of the nucleotides of a RNAi agent of the disclosure are modified. RNAi agents of the disclosure in which "substantially all of the nucleotides are modified" are largely but not wholly modified and can include not more than 5, 4, 3, 2, or 1 unmodified nucleotides.

The nucleic acids featured in the disclosure can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of RNAi agents useful in the embodiments described herein include, but are not limited to, RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified RNAi agent will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276, 019; 5,278,302; 5,286,717; 5,321,131; 5,399,676; 5,405, 939; 5,453,496; 5,455,233; 5,466,677; 5,476,925; 5,519, 126; 5,536,821; 5,541,316; 5,550,111; 5,563,253; 5,571, 799; 5,587,361; 5,625,050; 6,028,188; 6,124,445; 6,160, 109; 6,169,170; 6,172,209; 6,239,265; 6,277,603; 6,326, 199; 6,346,614; 6,444,423; 6,531,590; 6,534,639; 6,608, 035; 6,683,167; 6,858,715; 6,867,294; 6,878,805; 7,015, 315; 7,041,816; 7,273,933; 7,321,029; and U.S. Pat. RE39464, the contents of each of which are hereby incorporated herein by reference for the methods provided therein.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the contents of each of which are hereby incorporated herein by reference for the methods provided therein.

In other embodiments, suitable RNA mimetics are contemplated for use in RNAi agents, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the contents of each of which are hereby incorporated herein by reference for the methods provided therein. Additional PNA compounds suitable for use in the RNAi agents of the disclosure are described in, for example, in Nielsen et al., Science, 1991, 254, 1497-1500.

Some embodiments featured in the disclosure include RNAs with phosphorothioate backbones and oligonucleo-sides with heteroatom backbones, and in particular —$CH_2$— NH—$CH_2$—, —$CH_2$—N($CH_3$)—O—$CH_2$—[known as a methylene (methylimino) or MMI backbone], —$CH_2$—O— N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The RNAi agents, e.g., dsRNAs, featured herein can include one of the following at the 2'-position: OH; F; O-, S-, or N-alkyl; O-, S-, or N-alkenyl; O—, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2'-position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of a RNAi agent, or a group for improving the pharmacodynamic properties of a RNAi agent, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2)_2$. Further exemplary modifications include: 5'-Me-2'-F nucleotides, 5'-Me-2'-Ome nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$), 2'-O-hexadecyl, and 2'-fluoro (2'-F). Similar modifications can also be made at other positions on the RNA of a RNAi agent, particularly the 3'-position of the sugar on the 3'-terminal nucleotide or in 2'-5'-linked dsRNAs and the 5'-position of 5'-terminal nucleotide. RNAi agents can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359, 044; 5,393,878; 5,446,137; 5,466,786; 5,514,785; 5,519, 134; 5,567,811; 5,576,427; 5,591,722; 5,597,909; 5,610, 300; 5,627,053; 5,639,873; 5,646,265; 5,658,873; 5,670, 633; and 5,700,920, certain of which are commonly owned with the instant application. The contents of each of the foregoing are hereby incorporated herein by reference for the methods provided therein.

A RNAi agent of the disclosure can also include nucleobase (often referred to in the art simply as "base") modifications or substitutions. As used herein, "unmodified" or "natural" nucleobases include the purine bases adenine (A)

and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) *Angewandte Chemie, International Edition*, 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the disclosure. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the contents of each of which are hereby incorporated herein by reference for the methods provided therein.

A RNAi agent of the disclosure can also be modified to include one or more locked nucleic acids (LNA). A locked nucleic acid is a nucleotide having a modified ribose moiety in which the ribose moiety comprises an extra bridge connecting the 2'- and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

A RNAi agent of the disclosure can also be modified to include one or more bicyclic sugar moities. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the disclosure may include one or more locked nucleic acids (LNA). A locked nucleic acid is a nucleotide having a modified ribose moiety in which the ribose moiety comprises an extra bridge connecting the 2'- and 4' carbons. In other words, an LNA is a nucleotide comprising a bicyclic sugar moiety comprising a 4'-CH2-O-2'-bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the disclosure include without limitation nucleosides comprising a bridge between the 4' and the 2' ribosyl ring atoms. In certain embodiments, the antisense polynucleotide agents of the disclosure include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.*, 2009, 74, 118-134); and 4'-CH2-C(=CH2)-2' (and analogs thereof; see, e.g., U.S. Pat. No. 8,278,426). The contents of each of the foregoing are incorporated herein by reference for the methods provided therein.

Additional representative US Patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the contents of each of which are hereby incorporated herein by reference for the methods provided therein.

Any of the foregoing bicyclic nucleosides can be prepared having one or more stereochemical sugar configurations including for example α-L-ribofuranose and β-D-ribofuranose (see WO 99/14226).

A RNAi agent of the disclosure can also be modified to include one or more constrained ethyl nucleotides. As used herein, a "constrained ethyl nucleotide" or "cEt" is a locked nucleic acid comprising a bicyclic sugar moiety comprising a 4'-CH(CH3)-0-2' bridge. In one embodiment, a constrained ethyl nucleotide is in the S conformation referred to herein as "S-cEt."

A RNAi agent of the disclosure may also include one or more "conformationally restricted nucleotides" ("CRN"). CRN are nucleotide analogs with a linker connecting the C2' and C4' carbons of ribose or the C3' and C5'-carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US 2013/0190383; and WO 2013/036868, the contents of each of which are hereby incorporated herein by reference for the methods provided therein.

In some embodiments, a RNAi agent of the disclosure comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3'-bond (i.e. the covalent carbon-carbon bond between the C2'- and C3'-carbons) of the sugar has been removed (see *Nuc. Acids Symp. Series,* 52, 133-134 (2008) and Fluiter et al., *Mol. Biosyst.,* 2009, 10, 1039).

Representative U.S. publications that teach the preparation of UNA include, but are not limited to, U.S. Pat. No. 8,314,227; and US Patent Publication Nos. 2013/0096289; 2013/0011922; and 2011/0313020, the contents of each of which are hereby incorporated herein by reference for the methods provided therein.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in WO 2011/005861.

Other modifications of a RNAi agent of the disclosure include a 5'-phosphate or 5'-phosphate mimic, e.g., a 5'-terminal phosphate or phosphate mimic on the antisense strand of a RNAi agent. Suitable phosphate mimics are disclosed in, for example US 2012/0157511, the contents of which are incorporated herein by reference for the methods provided therein.

A. Modified RNAi Agents Comprising Motifs of the Disclosure

In certain aspects of the disclosure, the double-stranded RNAi agents of the disclosure include agents with chemical modifications as disclosed, for example, in WO 2013/075035, the contents of which are incorporated herein by reference for the methods provided therein. As shown herein and in WO 2013/075035, a superior result may be obtained by introducing one or more motifs of three identical modifications on three consecutive nucleotides into a sense strand or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense or antisense strand. The RNAi agent may be optionally conjugated with a lipophilic ligand, e.g., a C16 ligand, for instance on the sense strand. The RNAi agent may be optionally modified with a (S)-glycol nucleic acid (GNA) modification, for instance on one or more residues of the antisense strand. The resulting RNAi agents present superior gene silencing activity.

Accordingly, the disclosure provides double-stranded RNAi agents capable of inhibiting the expression of a target gene (i.e., an ATXN3 gene) in vivo. The RNAi agent comprises a sense strand and an antisense strand. Each strand of the RNAi agent may be 15-30 nucleotides in length. For example, each strand may be 16-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length. In certain embodiments, each strand is 19-23 nucleotides in length.

The sense strand and antisense strand typically form a duplex double-stranded RNA ("dsRNA"), also referred to herein as an "RNAi agent." The duplex region of an RNAi agent may be 15-30 nucleotide pairs in length. For example, the duplex region can be 16-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length. In certain embodiments, the duplex region is 19-21 nucleotide pairs in length.

In one embodiment, the RNAi agent may contain one or more overhang regions or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the nucleotide overhang region is 2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-O-methyl, deoxythymidine (T), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'-end. The antisense strand contains at least one motif of three 2'-O-methyl modifications on three consecutive nucleotides at positions 11, 12, 13 from the 5'-end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'-end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'-end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'-end; the antisense strand contains at least one motif of three 2'-O-methyl modifications on three consecutive nucleotides at positions 11, 12, 13 from the 5'-end, wherein one end of the RNAi agent is blunt, while the other end comprises a 2 nucleotide overhang. Preferably, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (e.g., a lipophilic ligand, optionally a C16-ligand).

In one embodiment, the RNAi agent comprises a sense and an antisense strand, wherein the sense strand is 25-30 nucleotide residues in length, wherein starting from the 5'-terminal nucleotide (position 1) positions 1 to 23 of the first strand comprise at least 8 ribonucleotides; the antisense strand is 36-66 nucleotide residues in length and, starting from the 3'-terminal nucleotide, comprises at least 8 ribonucleotides in the positions paired with positions 1-23 of sense strand to form a duplex; wherein at least the 3 terminal nucleotide of antisense strand is unpaired with sense strand, and up to 6 consecutive 3'-terminal nucleotides are unpaired with sense strand, thereby forming a 3'-single stranded overhang of 1-6 nucleotides; wherein the 5'-terminus of antisense strand comprises from 10-30 consecutive nucleotides which are unpaired with sense strand, thereby forming a 10-30 nucleotide single stranded 5'-overhang; wherein at least the sense strand 5'-terminal and 3'-terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double-stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5'-end; wherein the 3'-end of the first strand and the 5'-end of the second strand form a blunt end and the second strand is 1-4 nucleotides longer at its 3'-end than the first strand, wherein the duplex region region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3'-end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand.

For an RNAi agent having a duplex region of 17-23 nucleotides in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two, or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two, or three nucleotides; two modifications one strand fall on each side of the lead motif, having an overlap of one, two, or three nucleotides in the duplex region.

In one embodiment, the RNAi agent comprises mismatch (es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2, or 3 base pairs within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense or antisense strand.

In one embodiment, the sense strand sequence may be represented by formula (I):

$$5'\ n_p\text{-}N_a\text{-}(X\ X\ X\ )_i\text{-}N_b\text{-}Y\ Y\ Y\ \text{-}N_b\text{-}(Z\ Z\ Z\ )_j\text{-}N_a\text{-}n_q\ 3' \tag{I}$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein $N_b$ and Y do not have the same modification; and

XXX, YYY and ZZZ each independently represent one motif of three identical modifications on three consecutive nucleotides. Preferably YYY is all 2'-F modified nucleotides.

In one embodiment, the $N_a$ or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11,12; or 11, 12, 13) of—the sense strand, the count starting from the $1^{st}$ nucleotide, from the 5'-end; or optionally, the count starting at the $1^{st}$ paired nucleotide within the duplex region, from the 5'-end.

In one embodiment, i is 1 and j is 0, or i is 0 and j is 1, or both i and j are 1. The sense strand can therefore be represented by the following formulas:

$$5' \ n_p\text{-}N_a\text{-}YYY\text{-}N_b\text{-}ZZZ\text{-}N_a\text{-}n_q \ 3'; \qquad (Ib)$$

$$5' \ n_p\text{-}N_a\text{-}XXX\text{-}N_b\text{-}YYY\text{-}N_a\text{-}n_q \ 3'; \qquad (Ic)$$
or $$5' \ n_p\text{-}N_a\text{-}XXX\text{-}N_b\text{-}YYY\text{-}N_b\text{-}ZZZ\text{-}N_a\text{-}n_q \ 3'. \qquad (Id)$$

When the sense strand is represented by formula (Ib), $N_b$ represents an oligonucleotide sequence comprising 0-10, 0-7, 0-5, 0-4, 0-2 or 0 modified nucleotides.

Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. Preferably, $N_b$ is 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5' \ n_p\text{-}N_a\text{-}YYY\text{-} \ N_a\text{-}n_q \ 3'. \qquad (Ia)$$

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

$$5' \ n_{q'}\text{-}N_a'\text{-}(Z'Z'Z')_k\text{-}N_b'\text{-}Y'Y'Y'\text{-}N_b'\text{-}(X'X'X')_l\text{-}N'_a\text{-}n_{p'} \qquad (II)$$
$$3'$$

wherein:

k and 1 are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the $1^{st}$ nucleotide, from the 5'-end; or optionally, the count starting at the $1^{st}$ paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and 1 is 0, or k is 0 and 1 is 1, or both k and 1 are 1.

The antisense strand can therefore be represented by the following formulas:

$$5' \ n_{q'}\text{-}N_a'\text{-}Z'Z'Z'\text{-}N_b'\text{-}Y'Y'Y'\text{-}N_a'\text{-}n_{p'} \ 3'; \qquad (IIb)$$

$$5' \ n_{q'}\text{-}N_a'\text{-}Y'Y'Y'\text{-}N_b'\text{-}X'X'X'\text{-}n_{p'} \ 3'; \qquad (IIc)$$
or $$5' \ n_{q'}\text{-}N_a'\text{-}Z'Z'Z'\text{-}N_b'\text{-}Y'Y'Y'\text{-}N_b'\text{-}X'X'X'\text{-}N_a'\text{-}n_{p'} \qquad (IId)$$
$$3'.$$

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

Preferably, $N_b$ is 0, 1, 2, 3, 4, 5, or 6.

In other embodiments, k is 0 and 1 is 0 and the antisense strand may be represented by the formula:

$$5'n_p'\text{-}N_a'\text{—}Y'Y'Y'\text{—}N_a\text{-}n_q3' \qquad (Ia).$$

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the $1^{st}$ nucleotide from the 5'-end, or optionally, the count starting at the $1^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the $1^{st}$ nucleotide from the 5'-end, or optionally, the count starting at the $1^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the disclosure may comprise a sense strand and an antisense strand, each strand having 14 to 30 nucleotides, the RNAi duplex represented by formula (III):

$$
\begin{aligned}
&\text{(III)} \\
&\text{sense:} \\
&5' \; n_p\text{-}N_a\text{-}(X\;X\;X)_i\;\text{-}N_b\text{-}\;Y\;Y\;Y\;\text{-}N_b\;\text{-}(Z\;Z\;Z)_j\text{-}N_a\text{-}n_q\;3' \\
\\
&\text{antisense:} \\
&3' \; n_p'\text{-}N_a'\text{-}(X'X'X')_k\text{-}N_b'\text{-}Y'Y'Y'\text{-}N_b'\text{-}(Z'Z'Z')\text{-}N_a'\text{-}n_q' \\
&5'
\end{aligned}
$$

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

$$
\begin{aligned}
&\text{(IIIa)} \\
&5' \; n_p \; \text{-} \; N_a\text{-}Y\;Y\;Y\;\text{-}N_a\text{-}n_q\;3' \\
\\
&3' \; n_p'\text{-}N_a'\text{-}Y'Y'Y'\;\text{-}N_a'n_q'\;5'
\end{aligned}
$$

$$
\begin{aligned}
&\text{(IIIb)} \\
&5' \; n_p\text{-}N_a\text{-}Y\;Y\;Y\;\text{-}N_b\text{-}Z\;Z\;Z\;\text{-}N_a\text{-}n_q\;3' \\
\\
&3' \; n_p'\text{-}N_a'\text{-}Y'Y'Y'\text{-}N_b'\text{-}Z'Z'Z'\text{-}N_a'n_q'\;5'
\end{aligned}
$$

$$
\begin{aligned}
&\text{(IIIc)} \\
&5' \; n_p\text{-}N_a\text{-}\;X\;X\;X\;\text{-}N_b\;\text{-}Y\;Y\;Y\;\text{-}\;N_a\text{-}n_q\;3' \\
\\
&3' \; n_p'\text{-}N_a'\text{-}X'X'X'\text{-}N_b'\text{-}Y'Y'Y'\text{-}N_a'\text{-}n_q'\;5'
\end{aligned}
$$

$$
\begin{aligned}
&\text{(IIId)} \\
&5' \; n_P\text{-}N_a\text{-}X\;X\;X\;\text{-}N_b\text{-}Y\;Y\;Y\;\text{-}N_b\text{-}\;Z\;Z\;Z\;\text{-}N_a\text{-}n_q\;3' \\
\\
&3' \; n_p'\text{-}N_a'\text{-}X'X'X'\text{-}N_b'\text{-}Y'Y'Y'\text{-}N_b'\text{-}Z'Z'Z'\text{-}N_a\text{-}n_q'\;5'
\end{aligned}
$$

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b'$; independently comprises modifications of alternating pattern.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more C16 (or related) moieties attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more lipophilic, e.g., C16 (or related) moieties, optionally attached through a bivalent or trivalent branched linker.

In one embodiment, when the RNAi agent is represented by formula (Ma), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more lipophilic, e.g., C16 (or related) moieties attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5'-end, and one or both of the 3'-ends and are optionally conjugated to a ligand. Each of the agents can target the same gene or two different genes; or each of the agents can target same gene at two different target sites.

Various publications describe multimeric RNAi agents that can be used in the methods of the disclosure. Such publications include WO2007/091269, WO2010/141511, WO2007/117686, WO2009/014887, and WO2011/031520; and U.S. Pat. No. 7,858,769, the contents of each of which are hereby incorporated herein by reference for the methods provided therein. In certain embodiments, the RNAi agents of the disclosure may include GalNAc ligands, even if such GalNAc ligands are currently projected to be of limited value for the preferred intrathecal/CNS delivery route(s) of the instant disclosure.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the disclosure is an agent selected from the group of agents listed in any one of Tables 2, 4A, 4B, 5, 7A, 7B, 10, 11, and 14. These agents may further comprise a ligand.

IV. ATXN3 Knockdown to Treat ATXN3-Associated Diseases

ATXN3

A number of biomarkers have been associated with SCA3 and are discussed, for example, in a review by Lima and Raposo (Adv Exp Med Biol. 2018; 1049:309-319). Some biomarkers are more amenable to monitoring during clinical trials or treatment (e.g., functional studies, neuroimaging studies, and markers that can be detected in easily obtained subject samples, e.g., blood) than others (e.g., markers present only in the CNS). Clinical biomarkers correspond to the most investigated markers so far in SCA3. Several standardized clinical tests, including rating scales, have been developed to measure different aspects of the SCA3 phenotype. Such measures have been validated in studies of the natural history of the disease, targeting different cohorts of patients. Advantages pinpointed for the widespread use of clinical markers are the relatively low requirement in time and their reduced cost, as well as the fact that they can be obtained without the need for any sophisticated equipment. Regardless of the progresses made with the development of more objective clinical scales, it is assumed that clinical measures are to a certain extent subjective (the complexity of the SCA3 phenotype further aggravates this limitation), insensitive to subtle changes in small periods of time, as well as potentially subjected to observational bias. Also, current clinical measures are limited as to their usefulness in the preataxic stage of the disease, a phase that should be extremely important on what concerns the development of therapeutics.

Neuroimaging information holds the promise of sensitivity and informativity; neuroimaging indicators, such as specific volumetric alterations, are already being used as primary endpoint in clinical trials of neurodegenerative diseases similar to SCA3 (clinicaltrials.gov—clinical trial NCT02336633).

The CAG repeat at the ATXN3 locus constitutes the primary trait biomarker of SCA3. Although the level of expansion is useful to determine expected age of onset, with a negative correlation between the number of CAG repeats in the expanded allele and age at onset, and severity of disease, the marker is not useful for monitoring disease progression or response to treatment. Similarly, although allelic variants at the interleukin-6 (IL-6), apolipoprotein E (APOE), and glucosylceramidase beta (GBA) genes; variation in the 3'-UTR at the ATXN3 gene and size of the normal SCA3 allele can also be disease modifiers in relation to age of onset and disease severity, the levels of the markers do not change during disease progression.

Raposo and colleagues hypothesized that in SCA3 patients the analysis of disease-specific transcriptional changes in blood, a peripheral tissue, had the potential to allow the identification of novel biomarkers. A cross-sectional study with SCA3 patients and controls, using the Illumina Human V4-HT12 array, confirmed the presence of differences in expression between the two groups (Raposo et al (2015) Mov Disord 30(7):968-975). Twenty-six genes, found to be up-regulated in patients, were selected for a first step of validation by quantitative real-time PCR (technical validation). From these 21 genes, fourteen were subsequently selected for validation by qPCR in a new set of SCA3 patients and controls. In this second validation step, the expression levels of FCGR3B (Fc fragment of IgG, low-affinity IIIb, receptor (CD16b)), CSF2RA (Colony-stimulating factor 2 receptor, alpha, low-affinity (granulocyte-macrophage), CLC (Charcot-Leyden crystal protein), FPR2 (Formyl peptide receptor 2), SLA (Src-like-adaptor), GPR97 (G protein-coupled receptor 97), P2RY13 (Purinergic receptor P2Y, G-protein coupled, 13), TNFSF14 (Tumor necrosis factor (ligand) superfamily, member 14), SELPLG (Selectin P ligand) and YIPF6 (Yip1 domain family, member 6) were found to be 1.11-2.60-fold higher in patients when compared to controls. Noteworthy, FCGR3B, P2RY13 and SELPLG genes were significantly up-regulated. Raposo and colleagues further shown that, particularly for FCGR3B and CLC, patients with shorter disease duration tended to have higher expression levels when compared with patients with longer disease duration.

In a separate study, Raposo ((2017) Predicting and tracking Machado-Joseph disease: biomarkers of diagnosis and prognosis. PhD dissertation, Universidade dos Acores) verified expression levels of the selected genes HSPB1 (heat shock 27 kDa protein 1), DNAJB1 (DnaJ (Hsp40) homolog, subfamily B, member 1), DNAJB12 (DnaJ (Hsp40) homolog, subfamily B, member 12), DNAJB14 (DnaJ (Hsp40) homolog, subfamily B, member 14), BAX (BCL2-associated X protein), BCL2 (B-cell CLL/lymphoma 2), SOD2 (superoxide dismutase 2, mitochondrial), IL1B (interleukin 1, beta) and IL6 (interleukin 6) correlated with disease. It was demonstrated that HSPB1 and BCL2 were significantly down-regulated in patients compared to controls. Given the previously highlighted importance of the preclinical stage of SCA3. The study was expanded to include samples from preataxic SCA3 subjects. mRNA levels adjusted for age at blood collection were obtained for a set of premanifest SCA3 subjects, patients and controls. BCL2 levels were distinct in SCA3 subjects as compared to controls, although not being able to differentiate between premanifest carriers and patients. Moreover, lower levels of IL6 mRNA were also found in preataxic carriers. A number of SCA3 mouse models are known in the art and can be used to demonstrate the efficacy of the RNAi agents provided herein. Some exemplary models are provided below. A mouse model containing a human yeast artificial chromosome (YAC) construct encompassing the MJD1 locus into which expanded (CAG)76 and (CAG)84 repeat motifs (SEQ ID NOS 1922-1923, respectively) provides mice which demonstrate a mild and slowly progressive cerebellar deficit, manifesting as early as 4 weeks of age. As the disease progresses, pelvic elevation becomes markedly flattened, accompanied by hypotonia, and motor and sensory loss. Neuronal intranuclear inclusion (NII) formation and cell loss is prominent in the pontine and dentate nuclei, with variable cell loss in other regions of the cerebellum from 4 weeks of age. Interestingly, peripheral nerve demyelination and axonal loss is detected in symptomatic mice from 26 weeks of age (Cemal et al., Hum. Mol. Gen. 11:1075-1094, 2002). A knock in mouse model of SCA3 expressing ataxin-3 with 148 CAG repeats (SEQ ID NO: 1924) under the control of the huntingtin promoter was generated by Boy et al., (Neurobiol. Dis. 37:284-293, 2010). The insertion results in ubiquitous expression of the CAG repeat SCA3 throughout the whole brain. The model resembles many features of the disease in humans, including a late onset of symptoms and CAG repeat instability in transmission to offspring, with observed a biphasic progression of the disease, with hyperactivity during the first months and decline of motor coordination after about 1 year of age. Two further CAG expansion SCA3 lineages were created by Silva-Fernandes et al., (Neurobiol. Dis. 40:163-176, 2010). Two transgenic mouse lineages expressing the expanded human ataxin-3 under the control of the CMV promoter: CMVMJD83 and CMVMJD94, carrying Q83 and Q94 stretches, respectively. Behavioral analysis revealed that the CMVMJD94 transgenic mice developed motor uncoordination, intergenerational instability of the CAG repeats and a tissue-specific increase in the somatic mosaicism of the repeat with aging. Histopathological analysis of these MJD mice at early and late stages of the disease revealed neuronal atrophy and astrogliosis in several brain regions; however, no signs of microglial activation or euroinflammatory response prior to the appearance of an overt phenotype were found.

The human GM06153 fibroblast cell line (available from the Coriell Institute) which includes an expanded CAG repeat region in ATXN3 can be used to assess the activity of agents to inhibit the expression of ATXN3 using the siRNA agents provided herein.

V. RNAi Agents Conjugated to Ligands

Another modification of the RNA of a RNAi agent of the disclosure involves chemically linking to the RNA one or more ligands, moieties or conjugates that enhance the activity, cellular distribution or cellular uptake of the RNAi. Such moieties include but are not limited to lipid moieties such as a cholesterol moiety (Letsinger et al., (1989) *Proc. Natl. Acid. Sci. USA*, 86: 6553-6556), cholic acid (Manoharan et al., (1994) *Biorg. Med. Chem. Let.*, 4:1053-1060), a thioether, e.g., beryl-S-tritylthiol (Manoharan et al., (1992) *Ann. N.Y. Acad. Sci.*, 660:306-309; Manoharan et al., (1993) *Biorg. Med. Chem. Let.*, 3:2765-2770), a thiocholesterol (Oberhauser et al., (1992) *Nucl. Acids Res.*, 20:533-538), an aliphatic chain, e.g., dodecandiol or undecyl residues (Saison-Behmoaras et al., (1991) *EMBO J*, 10:1111-1118; Kabanov et al., (1990) *FEBS Lett.*, 259:327-330; Svinarchuk et al., (1993) *Biochimie*, 75:49-54), a phospholipid, e.g., di-hexadecyl-rac-glycerol or triethyl-ammonium 1,2-di-O-hexadecyl-rac-glycero-3-phosphonate (Manoharan et al., (1995) *Tetrahedron Lett.*, 36:3651-3654; Shea et al., (1990) *Nucl. Acids Res.*, 18:3777-3783), a polyamine or a polyethylene glycol chain (Manoharan et al., (1995) *Nucleosides & Nucleotides,* 14:969-973), or adamantane acetic acid (Manoharan et al., (1995) *Tetrahedron Lett.,* 36:3651-3654), a palmityl moiety (Mishra et al., (1995) *Biochim. Biophys. Acta,* 1264:229-237), or an octadecylamine or hexylamino-carbonyloxycholesterol moiety (Crooke et al., (1996) *J. Pharmacol. Exp. Ther.,* 277:923-937).

In one embodiment, a ligand alters the distribution, targeting, or half life of a RNAi agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Examples of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralen, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a CNS cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose.

The ligand can be a substance, e.g., a drug, which can increase the uptake of the RNAi agent into the cell, for example, by disrupting the cell's cytoskeleton, e.g., by disrupting the cell's microtubules, microfilaments, or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to a RNAi agent as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin, etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present disclosure as ligands (e.g. as PK modulating ligands). In addition, aptamers that bind serum components (e.g. serum proteins) are also suitable for use as PK modulating ligands in the embodiments described herein.

Ligand-conjugated oligonucleotides of the disclosure may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present disclosure may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present disclosure, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present disclosure are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipophilic Moieties

In certain embodiments, the lipophilic moiety is an aliphatic, cyclic such as alicyclic, or polycyclic such as polyalicyclic compound, such as a steroid (e.g., sterol) or a linear or branched aliphatic hydrocarbon. The lipophilic moiety may generally comprise a hydrocarbon chain, which may be cyclic or acyclic. The hydrocarbon chain may comprise various substituents or one or more heteroatoms, such as an oxygen or nitrogen atom. Such lipophilic aliphatic moieties include, without limitation, saturated or unsaturated $C_4$-$C_{30}$ hydrocarbon (e.g., $C_6$-$C_{18}$ hydrocarbon), saturated or unsaturated fatty acids, waxes (e.g., monohydric alcohol esters of fatty acids and fatty diamides), terpenes (e.g., $C_{10}$ terpenes, $C_{15}$ sesquiterpenes, $C_{20}$ diterpenes, $C_{30}$ triterpenes, and $C_{40}$ tetraterpenes), and other polyalicyclic hydrocarbons. For instance, the lipophilic moiety may contain a $C_4$-$C_{30}$ hydrocarbon chain (e.g., $C_4$-$C_{30}$ alkyl or alkenyl). In some embodiment the lipophilic moiety contains a saturated or unsaturated $C_6$-$C_{18}$ hydrocarbon chain (e.g., a linear $C_6$-$C_{18}$ alkyl or alkenyl). In one embodiment, the lipophilic moiety contains a saturated or unsaturated $C_{16}$ hydrocarbon chain (e.g., a linear $C_{16}$ alkyl or alkenyl).

The lipophilic moiety may be attached to the RNAi agent by any method known in the art, including via a functional grouping already present in the lipophilic moiety or introduced into the RNAi agent, such as a hydroxy group (e.g., —CO—CH$_2$—OH). The functional groups already present in the lipophilic moiety or introduced into the RNAi agent include, but are not limited to, hydroxyl, amine, carboxylic acid, sulfonate, phosphate, thiol, azide, and alkyne.

Conjugation of the RNAi agent and the lipophilic moiety may occur, for example, through formation of an ether or a carboxylic or carbamoyl ester linkage between the hydroxy and an alkyl group R—, an alkanoyl group RCO— or a substituted carbamoyl group RNHCO—. The alkyl group R may be cyclic (e.g., cyclohexyl) or acyclic (e.g., straight-chained or branched; and saturated or unsaturated). Alkyl group R may be a butyl, pentyl, hexyl, heptyl, octyl, nonyl, decyl, undecyl, dodecyl, tridecyl, tetradecyl, pentadecyl, hexadecyl, heptadecyl or octadecyl group, or the like.

In some embodiments, the lipophilic moiety is conjugated to the double-stranded RNAi agent via a linker a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

In another embodiment, the lipophilic moiety is a steroid, such as sterol. Steroids are polycyclic compounds containing a perhydro-1,2-cyclopentanophenanthrene ring system. Steroids include, without limitation, bile acids (e.g., cholic acid, deoxycholic acid and dehydrocholic acid), cortisone, digoxigenin, testosterone, cholesterol, and cationic steroids, such as cortisone. A "cholesterol derivative" refers to a compound derived from cholesterol, for example by substitution, addition or removal of substituents.

In another embodiment, the lipophilic moiety is an aromatic moiety. In this context, the term "aromatic" refers broadly to mono- and polyaromatic hydrocarbons. Aromatic groups include, without limitation, $C_6$-$C_{14}$ aryl moieties comprising one to three aromatic rings, which may be optionally substituted; "aralkyl" or "arylalkyl" groups comprising an aryl group covalently linked to an alkyl group, either of which may independently be optionally substituted or unsubstituted; and "heteroaryl" groups. As used herein, the term "heteroaryl" refers to groups having 5 to 14 ring atoms, preferably 5, 6, 9, or 10 ring atoms; having 6, 10, or 14n electrons shared in a cyclic array, and having, in addition to carbon atoms, one to about three heteroatoms selected from the group consisting of nitrogen (N), oxygen (O), and sulfur (S).

As employed herein, a "substituted" alkyl, cycloalkyl, aryl, heteroaryl, or heterocyclic group is one having one to about four, preferably one to about three, more preferably one or two, non-hydrogen substituents. Suitable substituents include, without limitation, halo, hydroxy, nitro, haloalkyl, alkyl, alkaryl, aryl, aralkyl, alkoxy, aryloxy, amino, acylamino, alkylcarbamoyl, arylcarbamoyl, aminoalkyl, alkoxycarbonyl, carboxy, hydroxyalkyl, alkanesulfonyl, arenesulfonyl, alkanesulfonamido, arenesulfonamido, aralkylsulfonamido, alkylcarbonyl, acyloxy, cyano, and ureido groups.

In some embodiments, the lipophilic moiety is an aralkyl group, e.g., a 2-arylpropanoyl moiety. The structural features of the aralkyl group are selected so that the lipophilic moiety will bind to at least one protein in vivo. In certain embodiments, the structural features of the aralkyl group are selected so that the lipophilic moiety binds to serum, vascular, or cellular proteins. In certain embodiments, the structural features of the aralkyl group promote binding to albumin, an immunoglobulin, a lipoprotein, α-2-macroglubulin, or α-1-glycoprotein.

In certain embodiments, the ligand is naproxen or a structural derivative of naproxen. Procedures for the synthesis of naproxen can be found in U.S. Pat. Nos. 3,904,682 and 4,009,197, which are hereby incorporated by reference in their entirety. Naproxen has the chemical name (S)-6-Methoxy-α-methyl-2-naphthaleneacetic acid and the structure is In certain embodiments, the ligand is ibuprofen or a structural derivative of ibuprofen. Procedures for the synthesis of ibuprofen can be found in U.S. Pat. No. 3,228,831, which is incorporated herein by reference for the methods provided therein. The structure of ibuprofen is Additional exemplary aralkyl groups are illustrated in U.S. Pat. No. 7,626,014, which is incorporated herein by reference for the methods provided therein.

In another embodiment, suitable lipophilic moieties include lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, ibuprofen, naproxen, dimethoxytrityl, or phenoxazine.

In certain embodiments, more than one lipophilic moiety can be incorporated into the double-strand RNAi agent, particularly when the lipophilic moiety has a low lipophilicity or hydrophobicity. In one embodiment, two or more lipophilic moieties are incorporated into the same strand of the double-strand RNAi agent. In one embodiment, each strand of the double-strand RNAi agent has one or more lipophilic moieties incorporated. In one embodiment, two or more lipophilic moieties are incorporated into the same position (i.e., the same nucleobase, same sugar moiety, or same internucleosidic linkage) of the double-strand RNAi agent. This can be achieved by, e.g., conjugating the two or more lipophilic moieties via a carrier, or conjugating the two or more lipophilic moieties via a branched linker, or conjugating the two or more lipophilic moieties via one or more linkers, with one or more linkers linking the lipophilic moieties consecutively.

The lipophilic moiety may be conjugated to the RNAi agent via a direct attachment to the ribosugar of the RNAi agent. Alternatively, the lipophilic moiety may be conjugated to the double-strand RNAi agent via a linker or a carrier.

In certain embodiments, the lipophilic moiety may be conjugated to the RNAi agent via one or more linkers (tethers).

In one embodiment, the lipophilic moiety is conjugated to the double-stranded RNAi agent via a linker containing an ether, thioether, urea, carbonate, amine, amide, maleimide-thioether, disulfide, phosphodiester, sulfonamide linkage, a product of a click reaction (e.g., a triazole from the azide-alkyne cycloaddition), or carbamate.

Exemplary linkers, tethers, carriers, nucleic acid modifications, conjugates, ligands and other moieties useful for achieving central nervous system-directed delivery of the ATXN3-targeting RNAi agents of the instant disclosure are described in additional detail, e.g., in WO/2019/217459 which is incorporated herein by reference in its entirety.

B. Lipid Conjugates

In one embodiment, the ligand or conjugate is a lipid or lipid-based molecule. Such a lipid or lipid-based molecule preferably binds a serum protein, e.g., human serum albumin (HSA). An HSA binding ligand allows for vascular distribution of the conjugate to a target tissue, e.g., a non-kidney target tissue of the body. In certain embodiments, the target tissue can be the CNS, including glial cells of the brain. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid-based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

Optionally, the lipid-based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid-based ligand binds HSA weakly or not at all, such that the conjugate will be preferably distributed to the kidney. Other moieties that target to kidney cells can also be used in place of or in addition to the lipid-based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as brain cells. Also included are HSA and low-density lipoprotein (LDL).

C. Cell Permeation Agents

In another aspect, the ligand is a cell-permeation agent, preferably a helical cell-permeation agent. Preferably, the agent is amphipathic. An exemplary agent is a peptide such as tat at or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to RNAi agents can affect pharmacokinetic distribution of the RNAi agent, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 9). An RFGF analogue (e.g., amino acid sequence AALLPVL-LAAP (SEQ ID NO: 10) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 11) and the Drosophila Antennapedia protein (RQIKIWFQNRRMKWKK (SEQ ID NO: 12) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the disclosure may be linear or cyclic, and may be modified, e.g., glycosylated or methylated, to facilitate targeting to a specific tissue(s). RGD-containing peptides and peptidomimetics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

D. Carbohydrate Conjugates and Ligands

In some embodiments of the compositions and methods of the disclosure, an RNAi agent oligonucleotide further comprises a carbohydrate. The carbohydrate conjugated RNAi agents are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the disclosure is a monosaccharide.

In certain embodiments, the compositions and methods of the disclosure include a C16 ligand. In exemplary embodiments, the C16 ligand of the disclosure has the following structure (exemplified here below for a uracil base, yet attachment of the C16 ligand is contemplated for a nucleotide presenting any base (C, G, A, etc.) or possessing any other modification as presented herein, provided that 2'-ribo attachment is preserved) and is attached at the 2'-position of the ribo within a residue that is so modified:

Chemical Formula: $C_{25}H_{43}N_2O_8P$
Exact Mass: 530.2757
Molecular Weight: 530.5913

As shown above, a C16 ligand-modified residue presents a straight chain alkyl at the 2'-ribo position of an exemplary residue (here, a Uracil) that is so modified.

In some embodiments, a carbohydrate conjugate of a RNAi agent of the instant disclosure further comprises one or more additional ligands as described above, such as, but not limited to, a PK modulator or a cell permeation peptide.

Additional carbohydrate conjugates (and linkers) suitable for use in the present disclosure include those described in WO 2014/179620 and WO 2014/179627, the entire contents of each of which are incorporated herein by reference.

In certain embodiments, the compositions and methods of the disclosure include a vinyl phosphonate (VP) modification of an RNAi agent as described herein. In exemplary embodiments, a vinyl phosphonate of the disclosure has the following structure:

A vinyl phosphonate of the instant disclosure may be attached to either the antisense or the sense strand of a dsRNA of the disclosure. In certain preferred embodiments, a vinyl phosphonate of the instant disclosure is attached to the antisense strand of a dsRNA, optionally at the 5'-end of the antisense strand of the dsRNA.

Vinyl phosphate modifications are also contemplated for the compositions and methods of the instant disclosure. An exemplary vinyl phosphate structure is:

E. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand) to reduce or inhibit off-target gene silencing. It has been discovered that dsRNAs with an antisense strand comprising at least one thermally destabilizing modification within the duplex within the first 9 nucleotide positions, counting from the 5'-end, of the antisense strand have reduced off-target gene silencing activity. Accordingly, in some embodiments, the antisense strand comprises at least one (e.g., one, two, three, four, five, or more) thermally destabilizing modification of the duplex within the first 9 nucleotide positions of the 5'-region of the antisense strand. In some embodiments, one or more thermally destabilizing modification(s) of the duplex is/are located in positions 2-9, or preferably positions 4-8, from the 5'-end of the antisense strand. In some further embodiments, the thermally destabilizing modification(s) of the duplex is/are located at position 6, 7, or 8 from the 5'-end of the antisense strand. In still some further embodiments, the thermally destabilizing modification of the duplex is located at position 7 from the 5'-end of the antisense strand. The term "thermally destabilizing modification(s)" includes modification(s) that would result with a dsRNA with a lower overall melting temperature (Tm) (preferably a Tm with one, two, three, or four degrees lower than the Tm of the dsRNA without having such modification(s). In some embodiments, the thermally destabilizing modification of the duplex is located at position 2, 3, 4, 5, or 9 from the 5'-end of the antisense strand.

The thermally destabilizing modifications can include, but are not limited to, abasic modification; mismatch with the opposing nucleotide in the opposing strand; and sugar modification such as 2'-deoxy modification or acyclic nucleotide, e.g., unlocked nucleic acids (UNA) or glycol nucleic acid (GNA).

Exemplified abasic modifications include, but are not limited to the following:

-continued

Wherein R═H, Me, et or OMe; R'═H, Me, et or OMe; R"═H, Me, et or OMe (2'-OMe Abasic Spacer)
Mod2

(3'-OMe)
Mod3

69

-continued

Mod4

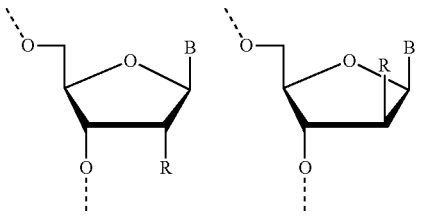

(5'-Me)
X = OMe, F

Mod5

(Hyp-spacer)

wherein B is a modified or unmodified nucleobase.

Exemplified sugar modifications include, but are not limited to the following:

2'-deoxy unlocked nucleic acid
R = H, OH, O-alkyl glycol nucleic acid
R = H, OH, O-alkyl

70

-continued glycol nucleic acid
R = H, OH, O-alkyl unlocked nucleic acid
R = H, OH, CH₃, CH₂CH₃, O-alkyl, NH₂, NHMe, NMe₂
R' = H, OH, CH₃, CH₂CH₃, O-alkyl, NH₂, NHMe, NMe₂
R'' = H, OH, CH₃, CH₂CH₃, O-alkyl, NH₂, NHMe, NMe₂
R''' = H, OH, CH₃, CH₂CH₃, O-alkyl, NH₂, NHMe, NMe₂
R'''' = H, OH, CH₃, CH₂CH₃, O-alkyl, NH₂, NHMe, NMe₂

R = H, methy, ethyl wherein B is a modified or unmodified nucleobase.

In some embodiments the thermally destabilizing modification of the duplex is selected from the group consisting of:

71
-continued

72
-continued wherein B is a modified or unmodified nucleobase and the asterisk on each structure represents either R, S or racemic.

The term "acyclic nucleotide" refers to any nucleotide having an acyclic ribose sugar, for example, where any of bonds between the ribose carbons (e.g., C1'-C2', C2'-C3', C3'-C4', C4'-O4', or C1'-O4') is absent or at least one of ribose carbons or oxygen (e.g., C1', C2', C3', C4', or O4') are independently or in combination absent from the nucleotide. In some embodiments, acyclic nucleotide is wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The term "UNA" refers to unlocked acyclic nucleic acid, wherein any of the bonds of the sugar has been removed, forming an unlocked "sugar" residue. In one example, UNA also encompasses monomers with bonds between C1'-C4' being removed (i.e. the covalent carbon-oxygen-carbon bond between the C1' and C4' carbons). In another example, the C2'-C3'-bond (i.e. the covalent carbon-carbon bond between the C2'- and C3'-carbons) of the sugar is removed (see Mikhailov et. al., Tetrahedron Letters, 26 (17): 2059 (1985); and Fluiter et al., Mol. Biosyst., 10: 1039 (2009), which are hereby incorporated by reference in their entirety). The acyclic derivative provides greater backbone flexibility without affecting the Watson-Crick pairings. The acyclic nucleotide can be linked via 2'-5'- or 3'-5'-linkage.

The term 'GNA' refers to glycol nucleic acid which is a polymer similar to DNA or RNA but differing in the composition of its "backbone" in that is composed of repeating glycerol units linked by phosphodiester bonds:

(R)-GNA

The thermally destabilizing modification of the duplex can be mismatches (i.e., noncomplementary base pairs) between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA molecule contains at least one nucleobase in the mismatch pairing that is a 2'-deoxy nucleobase; e.g., the 2'-deoxy nucleobase is in the sense strand.

In some embodiments, the thermally destabilizing modification of the duplex in the seed region of the antisense strand includes nucleotides with impaired W—C H-bonding to complementary base on the target mRNA, such as:

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

In some embodiments, the thermally destabilizing modification of the duplex includes nucleotides with non-canonical bases such as, but not limited to, nucleobase modifications with impaired or completely abolished capability to form hydrogen bonds with bases in the opposite strand. These nucleobase modifications have been evaluated for destabilization of the central region of the dsRNA duplex as described in WO 2010/0011895, which is herein incorporated by reference in its entirety. Exemplary nucleobase modifications are:

inosine

-continued nebularine 2-aminopurine 2,4-
difluorotoluene 5-nitroindole 3-nitropyrrole 4-Fluoro-6-
methylbinzimidazole 4-Methylbenzimidazole In some embodiments, the thermally destabilizing modi-
fication of the duplex in the seed region of the antisense
strand includes one or more α-nucleotide complementary to
the base on the target mRNA, such as:

wherein R is H, OH, OCH$_3$, F, NH$_2$, nHMe, NMe$_2$ or
O-alkyl.

Exemplary phosphate modifications known to decrease
the thermal stability of dsRNA duplexes compared to natural
phosphodiester linkages are:

-continued $$O = P - R$$

$$O = P - NH - R$$

$$O = P - O - R$$

R = alkyl

The alkyl for the R group can be a $C_1$-$C_6$alkyl. Specific alkyls for the R group include, but are not limited to methyl, ethyl, propyl, isopropyl, butyl, pentyl and hexyl. As the skilled artisan will recognize, in view of the functional role of nucleobases is defining specificity of a RNAi agent of the disclosure, while nucleobase modifications can be performed in the various manners as described herein, e.g., to introduce destabilizing modifications into a RNAi agent of the disclosure, e.g., for purpose of enhancing on-target effect relative to off-target effect, the range of modifications available and, in general, present upon RNAi agents of the disclosure tends to be much greater for non-nucleobase modifications, e.g., modifications to sugar groups or phosphate backbones of polyribonucleotides. Such modifications are described in greater detail in other sections of the instant disclosure and are expressly contemplated for RNAi agents of the disclosure, either possessing native nucleobases or modified nucleobases as described above or elsewhere herein.

In addition to the antisense strand comprising a thermally destabilizing modification, the dsRNA can also comprise one or more stabilizing modifications. For example, the dsRNA can comprise at least two (e.g., two, three, four, five, six, seven, eight, nine, ten, or more) stabilizing modifications. Without limitations, the stabilizing modifications all can be present in one strand. In some embodiments, both the sense and the antisense strands comprise at least two stabilizing modifications. The stabilizing modification can occur on any nucleotide of the sense strand or antisense strand. For instance, the stabilizing modification can occur on every nucleotide on the sense strand or antisense strand; each stabilizing modification can occur in an alternating pattern on the sense strand or antisense strand; or the sense strand or antisense strand comprises both stabilizing modification in an alternating pattern. The alternating pattern of the stabilizing modifications on the sense strand may be the same or different from the antisense strand, and the alternating pattern of the stabilizing modifications on the sense strand can have a shift relative to the alternating pattern of the stabilizing modifications on the antisense strand.

In some embodiments, the antisense strand comprises at least two (e.g., two, three, four, five, six, seven, eight, nine, ten, or more) stabilizing modifications. Without limitations, a stabilizing modification in the antisense strand can be present at any positions. In some embodiments, the antisense strand comprises stabilizing modifications at positions 2, 6, 8, 9, 14, and 16 from the 5'-end. In some other embodiments, the antisense strand comprises stabilizing modifications at positions 2, 6, 14, and 16 from the 5'-end. In still some other embodiments, the antisense strand comprises stabilizing modifications at positions 2, 14, and 16 from the 5'-end.

In some embodiments, the antisense strand comprises at least one stabilizing modification adjacent to the destabilizing modification. For example, the stabilizing modification can be the nucleotide at the 5'-end or the 3'-end of the destabilizing modification, i.e., at position −1 or +1 from the position of the destabilizing modification. In some embodiments, the antisense strand comprises a stabilizing modification at each of the 5'-end and the 3'-end of the destabilizing modification, i.e., positions −1 and +1 from the position of the destabilizing modification.

In some embodiments, the antisense strand comprises at least two stabilizing modifications at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) stabilizing modifications. Without limitations, a stabilizing modification in the sense strand can be present at any positions. In some embodiments, the sense strand comprises stabilizing modifications at positions 7, 10, and 11 from the 5'-end. In some other embodiments, the sense strand comprises stabilizing modifications at positions 7, 9, 10, and 11 from the 5'-end. In some embodiments, the sense strand comprises stabilizing modifications at positions opposite or complimentary to positions 11, 12, and 15 of the antisense strand, counting from the 5'-end of the antisense strand. In some other embodiments, the sense strand comprises stabilizing modifications at positions opposite or complimentary to positions 11, 12, 13, and 15 of the antisense strand, counting from the 5'-end of the antisense strand. In some embodiments, the sense strand comprises a block of two, three, or four stabilizing modifications.

In some embodiments, the sense strand does not comprise a stabilizing modification in position opposite or complimentary to the thermally destabilizing modification of the duplex in the antisense strand.

Exemplary thermally stabilizing modifications include, but are not limited to, 2'-fluoro modifications. Other thermally stabilizing modifications include, but are not limited to, LNA.

In some embodiments, the dsRNA of the disclosure comprises at least four (e.g., four, five, six, seven, eight, nine, ten, or more) 2'-fluoro nucleotides. Without limitations, the 2'-fluoro nucleotides all can be present in one strand. In some embodiments, both the sense and the antisense strands comprise at least two 2'-fluoro nucleotides. The 2'-fluoro modification can occur on any nucleotide of the sense strand or antisense strand. For instance, the 2'-fluoro modification can occur on every nucleotide on the sense strand or antisense strand; each 2'-fluoro modification can occur in an alternating pattern on the sense strand or antisense strand; or the sense strand or antisense strand comprises both 2'-fluoro modifications in an alternating pattern. The alternating pattern of the 2'-fluoro modifications on the sense strand may be the same or different from the antisense strand, and the alternating pattern of the 2'-fluoro modifications on the sense strand can have a shift relative to the alternating pattern of the 2'-fluoro modifications on the antisense strand.

In some embodiments, the antisense strand comprises at least two (e.g., two, three, four, five, six, seven, eight, nine, ten, or more) 2'-fluoro nucleotides. Without limitations, a 2'-fluoro modification in the antisense strand can be present at any positions. In some embodiments, the antisense comprises 2'-fluoro nucleotides at positions 2, 6, 8, 9, 14, and 16 from the 5'-end. In some other embodiments, the antisense comprises 2'-fluoro nucleotides at positions 2, 6, 14, and 16 from the 5'-end. In still some other embodiments, the antisense comprises 2'-fluoro nucleotides at positions 2, 14, and 16 from the 5'-end.

In some embodiments, the antisense strand comprises at least one 2'-fluoro nucleotide adjacent to the destabilizing modification. For example, the 2'-fluoro nucleotide can be the nucleotide at the 5'-end or the 3'-end of the destabilizing modification, i.e., at position −1 or +1 from the position of the destabilizing modification. In some embodiments, the antisense strand comprises a 2'-fluoro nucleotide at each of the 5'-end and the 3'-end of the destabilizing modification, i.e., positions −1 and +1 from the position of the destabilizing modification.

In some embodiments, the antisense strand comprises at least two 2'-fluoro nucleotides at the 3'-end of the destabilizing modification, i.e., at positions +1 and +2 from the position of the destabilizing modification.

In some embodiments, the sense strand comprises at least two (e.g., two, three, four, five, six, seven, eight, nine, ten, or more) 2'-fluoro nucleotides. Without limitations, a 2'-fluoro modification in the sense strand can be present at any positions.

In some embodiments, the antisense comprises 2'-fluoro nucleotides at positions 7, 10, and 11 from the 5'-end. In some other embodiments, the sense strand comprises 2'-fluoro nucleotides at positions 7, 9, 10, and 11 from the 5'-end. In some embodiments, the sense strand comprises 2'-fluoro nucleotides at positions opposite or complimentary to positions 11, 12, and 15 of the antisense strand, counting from the 5'-end of the antisense strand. In some other embodiments, the sense strand comprises 2'-fluoro nucleotides at positions opposite or complimentary to positions 11, 12, 13, and 15 of the antisense strand, counting from the 5'-end of the antisense strand. In some embodiments, the sense strand comprises a block of two, three, or four 2'-fluoro nucleotides.

In some embodiments, the sense strand does not comprise a 2'-fluoro nucleotide in position opposite or complimentary to the thermally destabilizing modification of the duplex in the antisense strand.

In some embodiments, the dsRNA molecule of the disclosure comprises a 21 nucleotides (nt) sense strand and a 23 nucleotides (nt) antisense, wherein the antisense strand contains at least one thermally destabilizing nucleotide, where the at least one thermally destabilizing nucleotide occurs in the seed region of the antisense strand (i.e., at position 2-9 of the 5'-end of the antisense strand), wherein one end of the dsRNA is blunt, while the other end is comprises a 2 nt overhang, and wherein the dsRNA optionally further has at least one (e.g., one, two, three, four, five, six, or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; (vi) the dsRNA comprises at least four 2'-fluoro modifications; and (vii) the dsRNA comprises a blunt end at 5'-end of the antisense strand. Preferably, the 2 nt overhang is at the 3'-end of the antisense.

In some embodiments, the dsRNA molecule of the disclosure comprising a sense and antisense strands, wherein: the sense strand is 25-30 nucleotide residues in length, wherein starting from the 5'-terminal nucleotide (position 1), positions 1 to 23 of said sense strand comprise at least 8 ribonucleotides; antisense strand is 36-66 nucleotide residues in length and, starting from the 3'-terminal nucleotide, at least 8 ribonucleotides in the positions paired with positions 1-23 of sense strand to form a duplex; wherein at least the 3 ' terminal nucleotide of antisense strand is unpaired with sense strand, and up to 6 consecutive 3'-terminal nucleotides are unpaired with sense strand, thereby forming a 3'-single stranded overhang of 1-6 nucleotides; wherein the 5'-terminus of antisense strand comprises from 10-30 consecutive nucleotides which are unpaired with sense strand, thereby forming a 10-30 nucleotide single stranded 5'-overhang; wherein at least the sense strand 5'-terminal and 3'-terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when said double-stranded nucleic acid is introduced into a mammalian cell; and wherein the antisense strand contains at least one thermally destabilizing nucleotide, where at least one thermally destabilizing nucleotide is in the seed region of the antisense strand (i.e. at position 2-9 of the 5'-end of the antisense strand). For example, the thermally destabilizing nucleotide occurs between positions opposite or complimentary to positions 14-17 of the 5'-end of the sense strand, and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA comprises a duplex region of 12-30 nucleotide pairs in length.

In some embodiments, the dsRNA molecule of the disclosure comprises a sense and antisense strands, wherein said dsRNA molecule comprises a sense strand having a length which is at least 25 and at most 29 nucleotides and an antisense strand having a length which is at most 30 nucleotides with the sense strand comprises a modified nucleotide that is susceptible to enzymatic degradation at position 11 from the 5'end, wherein the 3'-end of said sense strand and the 5'-end of said antisense strand form a blunt end and said antisense strand is 1~4 nucleotides longer at its 3'-end than the sense strand, wherein the duplex region which is at least 25 nucleotides in length, and said antisense strand is sufficiently complementary to a target mRNA along at least 19 nt of said antisense strand length to reduce target gene expression when said dsRNA molecule is introduced into a mammalian cell, and wherein dicer cleavage of said dsRNA preferentially results in an siRNA comprising said 3'-end of said antisense strand, thereby reducing expression of the target gene in the mammal, wherein the antisense strand contains at least one thermally destabilizing nucleotide, where the at least one thermally destabilizing nucleotide is in the seed region of the antisense strand (i.e. at position 2-9 of the 5'-end of the antisense strand), and wherein the dsRNA optionally further has at least one (e.g., one, two, three, four, five, six, or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA has a duplex region of 12-29 nucleotide pairs in length.

In some embodiments, every nucleotide in the sense strand and antisense strand of the dsRNA molecule may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases, the modification will occur at all of the subject positions in the nucleic acid but in many cases it will not. By way of example, a modification may only occur at a 3'- or 5'-terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of an RNA. E.g., a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. E.g., it can be desirable to include purine nucleotides in overhangs. In some embodiments all or some of the bases in a 3'- or 5'-overhang may be modified, e.g., with a modification described herein. Modifications can include, e.g., the use of modifications at the 2'-position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, HNA, CeNA, 2'-methoxyethyl, 2'-O-methyl, 2'-O-allyl, 2'-C-allyl, 2'-deoxy, or 2'-fluoro. The strands can contain more than one modification. In some embodiments, each residue of the sense strand and antisense strand is independ-

82 dently modified with 2'-O-methyl or 2'-fluoro. It is to be understood that these modifications are in addition to the at least one thermally destabilizing modification of the duplex present in the antisense strand.

At least two different modifications are typically present on the sense strand and antisense strand. Those two modifications may be the 2'-deoxy, 2'-O-methyl, or 2'-fluoro modifications, acyclic nucleotides or others. In some embodiments, the sense strand and antisense strand each comprises two differently modified nucleotides selected from 2'-O-methyl or 2'-deoxy. In some embodiments, each residue of the sense strand and antisense strand is independently modified with 2'-O-methyl nucleotide, 2'-deoxy nucleotide, 2'-deoxy-2'-fluoro nucleotide, 2'-O—N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, or 2'-ara-F nucleotide. Again, it is to be understood that these modifications are in addition to the at least one thermally destabilizing modification of the duplex present in the antisense strand.

In some embodiments, the dsRNA molecule of the disclosure comprises modifications of an alternating pattern, particular in the B1, B2, B3, B1', B2', B3', B4' regions. The term "alternating motif" or "alternative pattern" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc. The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNA molecule of the disclosure comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 3'-5' of the strand within the duplex region. As another example, the alternating motif in the sense strand may start with "AABBAABB" from 5'-3' of the strand and the alternating motif in the antisense strand may start with "BBAABBAA" from 3'-5' of the strand within the duplex region, so that there is a complete or partial shift of the modification patterns between the sense strand and the antisense strand.

The dsRNA molecule of the disclosure may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA molecule comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. Preferably, these terminal three nucleotides may be at the 3'-end of the antisense strand.

In some embodiments, the sense strand of the dsRNA molecule comprises 1-10 blocks of two to ten phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of three phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of four phosphorothioate or methylphosphonate internucleotide linkages separated by 1, 2, 3, 4, 5, 6, 7, 8, 9, 10, 11, 12, 13, or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of five phosphorothioate or methylphosphonate internucleotide linkages separated by 1, 2, 3, 4, 5, 6, 7, 8, 9, 10, 11, or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of six phosphorothioate or methylphosphonate internucleotide linkages separated by 1, 2, 3, 4, 5, 6, 7, 8, 9, or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of seven phosphorothioate or methylphosphonate internucleotide linkages separated by 1, 2, 3, 4, 5, 6, 7, or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of eight phosphorothioate or methylphosphonate internucleotide linkages separated by 1, 2, 3, 4, 5, or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the antisense strand of the dsRNA molecule comprises two blocks of nine phosphorothioate or methylphosphonate internucleotide linkages separated by 1, 2, 3, or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate, and phosphate internucleotide linkages or an antisense strand comprising either phosphorothioate or methylphosphonate or phosphate linkage.

In some embodiments, the dsRNA molecule of the disclosure further comprises one or more phosphorothioate or methylphosphonate internucleotide linkage modification within positions 1-10 of the termini position(s) of the sense or antisense strand. For example, at least 2, 3, 4, 5, 6, 7, 8, 9, or 10 nucleotides may be linked through phosphorothioate or methylphosphonate internucleotide linkage at one end or both ends of the sense or antisense strand.

In some embodiments, the dsRNA molecule of the disclosure further comprises one or more phosphorothioate or methylphosphonate internucleotide linkage modification within positions 1-10 of the internal region of the duplex of each of the sense or antisense strand. For example, at least 2, 3, 4, 5, 6, 7, 8, 9, or 10 nucleotides may be linked through phosphorothioate methylphosphonate internucleotide linkage at position 8-16 of the duplex region counting from the 5'-end of the sense strand; the dsRNA molecule can optionally further comprise one or more phosphorothioate or methylphosphonate internucleotide linkage modification within positions 1-10 of the termini position(s).

In some embodiments, the dsRNA molecule of the disclosure further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modification at positions 1 and 2 and one to five within positions 18-23 of the antisense strand (counting from the 5'-end).

In some embodiments, the dsRNA molecule of the disclosure further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at positions 1 and 2 and two phosphorothioate or methylphosphonate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises one phosphorothioate internucleotide linkage modification within position 1-5 and one within position 18-23 of the sense strand (counting from the 5'-end), and two phosphorothioate internucleotide linkage modification at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 (counting from the 5'-end) of the sense strand, and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 20 and 21 of the sense strand (counting from the 5'-end), and one phosphorothioate internucleotide linkage modification at positions 1 and one at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 22 and 23 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 23 and 23 the antisense strand (counting from the 5'-end).

In some embodiments, compound of the disclosure comprises a pattern of backbone chiral centers. In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration. In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, compound of the disclosure comprises a block is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, compound of the disclosure comprises a 5'-block is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, compound of the disclosure comprises a type of nucleoside in a region or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp.

In some embodiments, the antisense strand comprises phosphorothioate internucleotide linkages between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the antisense comprises 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand. In some embodiments, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the sense strand is conjugated with a ligand; (iii) the sense strand comprises 2, 3, 4, or 5 2'-fluoro modifications; (iv) the sense strand comprises 1, 2, 3, 4, or 5 phosphorothioate internucleotide linkages; (v) the dsRNA comprises at least four 2'-fluoro modifications; (vi) the dsRNA comprises a duplex region of 12-40 nucleotide pairs in length; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5, or 6 2'-fluoro modifications; (ii) the sense strand is conjugated with a ligand; (iii) the sense strand comprises 2, 3, 4, or 5 2'-fluoro modifications; (iv) the sense strand comprises 3, 4, or 5 phosphorothioate internucleotide linkages; (v) the dsRNA comprises at least four 2'-fluoro modifications; (vi) the dsRNA comprises a duplex region of 12-40 nucleotide pairs in length; and (vii) the dsRNA has a blunt end at 5'-end of the antisense strand.

In some embodiments, the dsRNA molecule of the disclosure comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In some embodiments, the dsRNA molecule of the disclosure comprises at least one of the first 1, 2, 3, 4, or 5 base pairs within the duplex regions from the 5'-end of the antisense strand can be chosen independently from the group of: A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

It was found that introducing 4'-modified or 5'-modified nucleotide to the 3'-end of a phosphodiester (PO), phosphorothioate (PS), or phosphorodithioate (PS2) linkage of a dinucleotide at any position of single stranded or double-stranded oligonucleotide can exert steric effect to the internucleotide linkage and, hence, protecting or stabilizing it against nucleases.

In some embodiments, 5'-modified nucleoside is introduced at the 3'-end of a dinucleotide at any position of single stranded or double-stranded siRNA. For instance, a 5'-alkylated nucleoside may be introduced at the 3'-end of a dinucleotide at any position of single stranded or double-stranded siRNA. The alkyl group at the 5'-position of the ribose sugar can be racemic or chirally pure R or S isomer. An exemplary 5'-alkylated nucleoside is 5'-methyl nucleoside. The 5'-methyl can be either racemic or chirally pure R or S isomer.

In some embodiments, 4'-modified nucleoside is introduced at the 3'-end of a dinucleotide at any position of single stranded or double-stranded siRNA. For instance, a 4'-alkylated nucleoside may be introduced at the 3'-end of a dinucleotide at any position of single stranded or double-stranded siRNA. The alkyl group at the 4' position of the ribose sugar can be racemic or chirally pure R or S isomer. An exemplary 4'-alkylated nucleoside is 4'-methyl nucleoside. The 4'-methyl can be either racemic or chirally pure R or S isomer. Alternatively, a 4'-O-alkylated nucleoside may be introduced at the 3'-end of a dinucleotide at any position of single stranded or double-stranded siRNA. The 4'-O-alkyl of the ribose sugar can be racemic or chirally pure R or S isomer. An exemplary 4'-O-alkylated nucleoside is 4'-O-methyl nucleoside. The 4'-O-methyl can be either racemic or chirally pure R or S isomer.

In some embodiments, 5'-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleoside is 5'-methyl nucleoside. The 5'-methyl can be either racemic or chirally pure R or S isomer.

In some embodiments, 4'-alkylated nucleoside is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleoside is 4'-methyl nucleoside. The 4'-methyl can be either racemic or chirally pure R or S isomer.

In some embodiments, 4'-O-alkylated nucleoside is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleoside is 4'-O-methyl nucleoside. The 4'-O-methyl can be either racemic or chirally pure R or S isomer.

In some embodiments, the dsRNA molecule of the disclosure can comprise 2'-5'-linkages (with 2'-H, 2'-OH, and 2'-OMe and with P=0 or P=S). For example, the 2'-5'-linkages modifications can be used to promote nuclease resistance or to inhibit binding of the sense to the antisense strand, or can be used at the 5'-end of the sense strand to avoid sense strand activation by RISC.

In another embodiment, the dsRNA molecule of the disclosure can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5'-end of the sense strand to avoid sense strand activation by RISC.

Various publications describe multimeric siRNA which can all be used with the dsRNA of the disclosure. Such publications include WO2007/091269, U.S. Pat. No. 7,858,769, WO2010/141511, WO2007/117686, WO2009/014887, and WO2011/031520 which are hereby incorporated by their entirely.

The dsRNA molecule that contains conjugations of one or more carbohydrate moieties to a dsRNA molecule can optimize one or more properties of the dsRNA molecule. In many cases, the carbohydrate moiety will be attached to a modified subunit of the dsRNA molecule. For example, the ribose sugar of one or more ribonucleotide subunits of a dsRNA molecule can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

In one embodiment the dsRNA molecule of the disclosure is conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3] dioxolane, oxazolidinyl, isoxazolidinyl, morpholinyl, thiazolidinyl, isothiazolidinyl, quinoxalinyl, pyridazinonyl, tetrahydrofuryl, and decalin; preferably, the acyclic group is selected from serinol backbone or diethanolamine backbone.

The double-stranded RNA (dsRNA) agent of the disclosure may optionally be conjugated to one or more ligands. The ligand can be attached to the sense strand, antisense strand or both strands, at the 3'-end, 5'-end, or both ends. For instance, the ligand may be conjugated to the sense strand, in particular, the 3'-end of the sense strand.

In some embodiments dsRNA molecules of the disclosure are 5'-phosphorylated or include a phosphoryl analog at the 5'-prime terminus. 5'-phosphate modifications include those which are compatible with RISC mediated gene silencing. Suitable modifications include: 5'-monophosphate ((HO)$_2$ (O)P—O-5'); 5'-diphosphate ((HO)$_2$(O)P—O—P(HO) (O)—O-5'); 5'-triphosphate ((HO)$_2$(O)P—O—(HO)(O)P—O—P(HO)(O)—O-5'); 5'-guanosine cap (7-methylated or non-methylated) (7m-G-O-5'-(HO)(O)P—O—(HO)(O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; (HO)$_2$(S)P—O-5'); 5'-monodithiophosphate (phosphorodithioate; (HO)(HS) (S)P—O-5'), 5'-phosphorothiolate ((HO)$_2$(O)P—S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)$_2$(O)P—NH-5', (HO)(NH$_2$)(O)P—O-5'), 5'-alkylphosphonates (R=alkyl=methyl, ethyl, isopropyl, propyl, etc., e.g. RP(OH)(O)—O-5'-, 5'-alkenylphosphonates (i.e. vinyl, substituted vinyl), (OH)$_2$(O)P-5'-CH2-), 5'-alkyletherphosphonates (R=alkylether=methoxymethyl (MeOCH2-), ethoxymethyl, etc., e.g. RP(OH)(O)—O-5'-). In one example, the modification can in placed in the antisense strand of a dsRNA molecule.

F. Linkers

In some embodiments, the conjugate or ligand described herein can be attached to a RNAi agent oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, SO$_2$, SO$_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroaryl-alkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), SO$_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is about 1-24, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times, or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least 2, 4, 10, 20, 30, 40, 50, 60, 70, 80, 90, or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups.

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S) (ORk)-O—, —O—P(S)(SRk)-O—, —S—P(O)(ORk)-O—, —O—P(O)(ORk)-S—, —S—P(O)(ORk)-S—, —O—P(S) (ORk)-S—, —S—P(S)(ORk)-O—, —O—P(O)(Rk)-O—, —O—P(S)(Rk)-O—, —S—P(O)(Rk)-O—, —S—P(S) (Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O) (OH)—O—, —O—P(O)(OH)—S—, —S—P(O)(OH)— S—, —O—P(S)(OH)—S—, —S—P(S)(OH)—O—, —O— P(O)(H)—O—, —O—P(S)(H)—O—, —S—P(O)(H)— O—, —S—P(S)(H)—O—, —S—P(O)(H)—S—, —O—P(S)(H)—S—. A preferred embodiment is —O—P (O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C═NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups in Another Embodiment, a Cleavable Linker comprises an ester-based cleavable linking group. An ester-based cleavable linking group is cleaved by enzymes such as esterases and amidases in cells. Examples of ester-based cleavable linking groups include but are not limited to esters of alkylene, alkenylene, and alkynylene groups. Ester cleavable linking groups have the general formula —C(O) O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides, etc.) and polypeptides. Peptide-based cleavable groups do not include the amide group (—C(O)NH—). The amide group can be formed between any alkylene, alkenylene, or alkynelene. A peptide bond is a special type of amide bond formed between amino acids to yield peptides and proteins. The peptide-based cleavage group is generally limited to the peptide bond (i.e., the amide bond) formed between amino acids yielding peptides and proteins and does not include the entire amide functional group. Peptide-based cleavable linking groups have the general formula —NHCHRAC(O) NHCHRBC(O)—, where RA and RB are the R groups of the two adjacent amino acids. These candidates can be evaluated using methods analogous to those described above.

Representative U.S. patents that teach the preparation of RNA conjugates include, but are not limited to, U.S. Pat. Nos. 4,828,979; 4,948,882; 5,218,105; 5,525,465; 5,541, 313; 5,545,730; 5,552,538; 5,578,717; 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245, 022; 5,254,469; 5,258,506; 5,262,536; 5,272,250; 5,292, 873; 5,317,098; 5,371,241; 5,391,723; 5,416,203; 5,451, 463; 5,510,475; 5,512,667; 5,514,785; 5,565,552; 5,567, 810; 5,574,142; 5,585,481; 5,587,371; 5,595,726; 5,597, 696; 5,599,923; 5,599,928; 5,688,941; 6,294,664; 6,320, 017; 6,576,752; 6,783,931; 6,900,297; 7,037,646; and 8,106,022, the contents of each of which are hereby incorporated herein by reference for the methods provided therein.

It is not necessary for all positions in a given compound to be uniformly modified, and in fact more than one of the aforementioned modifications can be incorporated in a single compound or even at a single nucleoside within a RNAi agent. The present disclosure also includes RNAi agents that are chimeric compounds.

"Chimeric" RNAi agents or "chimeras," in the context of this disclosure, are RNAi agents, preferably dsRNAs, which contain two or more chemically distinct regions, each made up of at least one monomer unit, i.e., a nucleotide in the case of a dsRNA compound. These RNAi agents typically contain at least one region wherein the RNA is modified so as to confer upon the RNAi agent increased resistance to nuclease degradation, increased cellular uptake, or increased binding affinity for the target nucleic acid.

In certain instances, the RNA of a RNAi agent can be modified by a non-ligand group. A number of non-ligand molecules have been conjugated to RNAi agents in order to enhance the activity, cellular distribution or cellular uptake of the RNAi agent, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O- hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

VI. Delivery of a RNAi Agent of the Disclosure

The delivery of a RNAi agent of the disclosure to a cell e.g., a cell within a subject, such as a human subject (e.g., a subject in need thereof, such as a subject having an ATXN3-associated disorder, e.g., SCA3) can be achieved in a number of different ways. For example, delivery may be performed by contacting a cell with a RNAi agent of the disclosure either in vitro or in vivo. In vivo delivery may also be performed directly by administering a composition comprising a RNAi agent, e.g., a dsRNA, to a subject. Alternatively, in vivo delivery may be performed indirectly by administering one or more vectors that encode and direct the expression of the RNAi agent. These alternatives are discussed further below.

In general, any method of delivering a nucleic acid molecule (in vitro or in vivo) can be adapted for use with a RNAi agent of the disclosure (see e.g., Akhtar S. and Julian R L., (1992) Trends Cell. Biol. 2(5):139-144 and WO94/ 02595, which are incorporated herein by reference in their entireties). For in vivo delivery, factors to consider in order to deliver a RNAi agent include, for example, biological stability of the delivered agent, prevention of non-specific effects, and accumulation of the delivered agent in the target tissue. The non-specific effects of a RNAi agent can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the RNAi agent to be administered. Several studies have shown successful knockdown of gene products when a RNAi agent is administered locally. For example, intraocular delivery of a VEGF dsRNA by intravitreal injection in cynomolgus monkeys (Tolentino, M J. et al., (2004) Retina 24:132-138) and subretinal injections in mice (Reich, S J. et al. (2003) Mol. Vis. 9:210-216) were both shown to prevent neovascularization in an experimental model of age-related macular degeneration. In addition, direct intratumoral injection of a dsRNA in mice reduces tumor volume (Pille, J. et al. (2005) Mol. Ther. 11:267-274) and can prolong survival of tumor-bearing mice (Kim, W J. et al., (2006) Mol. Ther. 14:343-350; Li, S. et al., (2007) Mol. Ther. 15:515-523). RNA interference has also shown success with local delivery to the CNS by direct injection (Dorn, G.

et al., (2004) *Nucleic Acids* 32:e49; Tan, P H. et al. (2005) *Gene Ther.* 12:59-66; Makimura, H. et al. (2002) *BMC Neurosci.* 3:18; Shishkina, G T., et al. (2004) *Neuroscience* 129:521-528; Thakker, E R., et al. (2004) *Proc. Natl. Acad. Sci. U.S.A.* 101:17270-17275; Akaneya, Y., et al. (2005) *J. Neurophysiol.* 93:594-602) and to the lungs by intranasal administration (Howard, K A. et al., (2006) *Mol. Ther.* 14:476-484; Zhang, X. et al., (2004) *J. Biol. Chem.* 279: 10677-10684; Bitko, V. et al., (2005) *Nat. Med.* 11:50-55).

For administering a RNAi agent systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the RNAi agent to the target tissue and avoid undesirable off-target effects (e.g., without wishing to be bound by theory, use of GNAs as described herein has been identified to destabilize the seed region of a dsRNA, resulting in enhanced preference of such dsRNAs for on-target effectiveness, relative to off-target effects, as such off-target effects are significantly weakened by such seed region destabilization). RNAi agents can be modified by chemical conjugation to lipophilic groups such as cholesterol to enhance cellular uptake and prevent degradation. For example, a RNAi agent directed against ApoB conjugated to a lipophilic cholesterol moiety was injected systemically into mice and resulted in knockdown of apoB mRNA in both the liver and jejunum (Soutschek, J. et al., (2004) *Nature* 432:173-178). Conjugation of a RNAi agent to an aptamer has been shown to inhibit tumor growth and mediate tumor regression in a mouse model of prostate cancer (McNamara, J O. et al., (2006) *Nat. Biotechnol.* 24:1005-1015). In an alternative embodiment, the RNAi agent can be delivered using drug delivery systems such as a nanoparticle, a dendrimer, a polymer, liposomes, or a cationic delivery system. Positively charged cationic delivery systems facilitate binding of molecule RNAi agent (negatively charged) and also enhance interactions at the negatively charged cell membrane to permit efficient uptake of a RNAi agent by the cell. Cationic lipids, dendrimers, or polymers can either be bound to a RNAi agent, or induced to form a vesicle or micelle (see e.g., Kim SH. et al., (2008) *Journal of Controlled Release* 129(2):107-116) that encases a RNAi agent. The formation of vesicles or micelles further prevents degradation of the RNAi agent when administered systemically. Methods for making and administering cationic-RNAi agent complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al. (2007) *J. Hypertens.* 25:197-205). Some non-limiting examples of drug delivery systems useful for systemic delivery of RNAi agents include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, a RNAi agent forms a complex with cyclodextrin for systemic administration. Methods for administration and pharmaceutical compositions of RNAi agents and cyclodextrins can be found in U.S. Pat. No. 7,427,605, which is herein incorporated by reference in its entirety.

Certain aspects of the instant disclosure relate to a method of reducing the expression of an ATXN3 target gene in a cell, comprising contacting said cell with the double-stranded RNAi agent of the disclosure. In one embodiment, the cell is an extrahepatic cell, optionally a CNS cell.

Another aspect of the disclosure relates to a method of reducing the expression of an ATXN3 target gene in a subject, comprising administering to the subject the double-stranded RNAi agent of the disclosure.

Another aspect of the disclosure relates to a method of treating a subject having a CNS disorder, comprising administering to the subject a therapeutically effective amount of the double-stranded ATXN3-targeting RNAi agent of the disclosure, thereby treating the subject. Exemplary CNS disorders that can be treated by the method of the disclosure include SCA3.

In one embodiment, the double-stranded RNAi agent is administered intrathecally. By intrathecal administration of the double-stranded RNAi agent, the method can reduce the expression of an ATXN3 target gene in a brain or spine tissue, for instance, the cortex, cerebellum, dorsal root ganglia, substantia nigra, cerebellar dentate nucleus, pallidum, striatum, brainstem, thalamus, subthalamic, red, and pontine nuclei, cranial nerve nuclei and the anterior horn; and Clarke's column of the spinal cord cervical spine, lumbar spine, or thoracic spine. For ease of exposition the formulations, compositions and methods in this section are discussed largely with regard to modified siRNA compounds. It may be understood, however, that these formulations, compositions and methods can be practiced with other siRNA compounds, e.g., unmodified siRNA compounds, and such practice is within the disclosure. A composition that includes a RNAi agent can be delivered to a subject by a variety of routes. Exemplary routes include intrathecal, intravenous, topical, rectal, anal, vaginal, nasal, pulmonary, and intraocular.

The RNAi agents of the disclosure can be incorporated into pharmaceutical compositions suitable for administration. Such compositions typically include one or more species of RNAi agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration, especially carriers compatible with administration of pharmaceutical agents to the CNS, e.g., intrathecal, intracranial, or intraventricular administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present disclosure may be administered in a number of ways depending upon whether local or systemic treatment is desired and upon the area to be treated. Administration may be topical (including ophthalmic, vaginal, rectal, intranasal, transdermal), oral, or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the RNAi agent in aerosol form. The vascular endothelial cells could be targeted by coating a balloon catheter with the RNAi agent and mechanically introducing the RNA. To target the brain, administering the RNA by injection into the brain or spinal cord.

Formulations for topical administration may include transdermal patches, ointments, lotions, creams, gels, drops, suppositories, sprays, liquids, and powders. Conventional pharmaceutical carriers, aqueous, powder or oily bases, thickeners and the like may be necessary or desirable. Coated condoms, gloves and the like may also be useful.

Compositions for oral administration include powders or granules, suspensions or solutions in water, syrups, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening or flavoring agents can be added.

Compositions for intrathecal or intraventricular administration may include sterile aqueous solutions which may also contain buffers, diluents, and other suitable additives.

Formulations for parenteral administration may include sterile aqueous solutions which may also contain buffers, diluents, and other suitable additives. Intraventricular injection may be facilitated by an intraventricular catheter, for example, attached to a reservoir. For intravenous use, the total concentration of solutes may be controlled to render the preparation isotonic.

In one embodiment, the administration of the siRNA compound, e.g., a double-stranded siRNA compound, or single-stranded siRNA (ssiRNA) compound, composition is parenteral, e.g., intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral, or ocular. Administration can be provided by the subject or by another person, e.g., a health care provider. The medication can be provided in measured doses or in a dispenser which delivers a metered dose. Selected modes of delivery are discussed in more detail below.

Intrathecal Administration. In one embodiment, the double-stranded RNAi agent is delivered by intrathecal injection (i.e. injection into the spinal fluid which bathes the brain and spinal cord tissue). Intrathecal injection of RNAi agents into the spinal fluid can be performed as a bolus injection or via minipumps which can be implanted beneath the skin, providing a regular and constant delivery of siRNA into the spinal fluid. The circulation of the spinal fluid from the choroid plexus, where it is produced, down around the spinal chord and dorsal root ganglia and subsequently up past the cerebellum and over the cortex to the arachnoid granulations, where the fluid can exit the CNS, that, depending upon size, stability, and solubility of the compounds injected, molecules delivered intrathecally hit targets throughout the entire CNS.

In some embodiments, the intrathecal administration is via a pump. The pump may be a surgically implanted osmotic pump. In one embodiment, the osmotic pump is implanted into the subarachnoid space of the spinal canal to facilitate intrathecal administration.

In some embodiments, the intrathecal administration is via an intrathecal delivery system for a pharmaceutical including a reservoir containing a volume of the pharmaceutical agent, and a pump configured to deliver a portion of the pharmaceutical agent contained in the reservoir. More details about this intrathecal delivery system may be found in WO2015/116658, which is incorporated by reference in its entirety.

The amount of intrathecally injected RNAi agents may vary from one target gene to another target gene and the appropriate amount that has to be applied may have to be determined individually for each target gene. Typically, this amount ranges from 10 µg to 2 mg, preferably 50 µg to 1500 µg, more preferably 100 µg to 1000 µg.

A. Vector Encoded RNAi Agents of the Disclosure

RNAi agents targeting the ATXN3 gene can be expressed from transcription units inserted into DNA or RNA vectors (see, e.g., Couture, A, et al., *TIG.* (1996), 12:5-10; WO 00/22113, WO 00/22114, and U.S. Pat. No. 6,054,299). Expression is preferably sustained (months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of a RNAi agent can be transcribed from a promoter on an expression vector. Where two separate strands are to be expressed to generate, for example, a dsRNA, two separate expression vectors can be co-introduced (e.g., by transfection or infection) into a target cell. Alternatively, each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

RNAi agent expression vectors are generally DNA plasmids or viral vectors. Expression vectors compatible with eukaryotic cells, preferably those compatible with vertebrate cells, can be used to produce recombinant constructs for the expression of a RNAi agent as described herein. Delivery of RNAi agent expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, Moloney murine leukemia virus, etc.; (c) adeno-associated virus vectors; (d) herpes simplex virus vectors; (e) SV 40 vectors; (l) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of a RNAi agent will generally require regulatory elements, e.g., promoters, enhancers, etc., to ensure the expression of the RNAi agent in target cells. Other aspects to consider for vectors and constructs are known in the art.

VII. Pharmaceutical Compositions of the Disclosure

The present disclosure also includes pharmaceutical compositions and formulations which include the RNAi agents of the disclosure. In one embodiment, provided herein are pharmaceutical compositions containing a RNAi agent, as described herein, and a pharmaceutically acceptable carrier. The pharmaceutical compositions containing the RNAi agent are useful for treating a disease or disorder associated with the expression or activity of ATXN3, e.g., SCA3. The pharmaceutical compositions of the invention are preferably nonpyrogenic.

Such pharmaceutical compositions are formulated based on the mode of delivery. One example is compositions that are formulated for systemic administration via parenteral delivery, e.g., by intravenous (IV), intramuscular (IM), or for subcutaneous (subQ) delivery. Another example is compositions that are formulated for direct delivery into the CNS, e.g., by intrathecal or intraventricular routes of injection, optionally by infusion into the brain, such as by continuous pump infusion.

The pharmaceutical compositions of the disclosure may be administered in dosages sufficient to inhibit expression of an ATXN3 gene. In general, a suitable dose of a RNAi agent of the disclosure will be in the range of about 0.001 to about 200.0 milligrams per kilogram body weight of the recipient per day, generally in the range of about 1 to 50 mg per kilogram body weight per day. A fixed dose can also be used.

A repeat-dose regimen may include administration of a therapeutic amount of a RNAi agent on a regular basis, such as monthly to once every six months. In certain embodiments, the RNAi agent is administered about once per quarter (i.e., about once every three months) to about twice per year.

After an initial treatment regimen (e.g., loading dose), the treatments can be administered on a less frequent basis.

The skilled artisan will appreciate that certain factors can influence the dosage and timing required to effectively treat a subject, including but not limited to the severity of the disease or disorder, previous treatments, the general health or age of the subject, and other diseases present. Moreover, treatment of a subject with a therapeutically effective amount of a composition can include a single treatment or a series of treatments.

Advances in mouse genetics have generated a number of mouse models for the study of SCA3, as provided above, that would benefit from reduction in the expression of ATXN3. Such models can be used for in vivo testing of RNAi agents, as well as for determining a therapeutically effective dose. Suitable mouse models are known in the art and include, for example, the SCA3 models described elsewhere herein.

The RNAi agents can be delivered in a manner to target a particular tissue, such as the CNS (e.g., Optionally, the brain or spine tissue is cortex, cerebellum, dorsal root ganglia, substantia nigra, cerebellar dentate nucleus, pallidum, striatum, brainstem, thalamus, subthalamic, red, and pontine nuclei, cranial nerve nuclei and the anterior horn; and Clarke's column of the spinal cord cervical spine, lumbar spine, or thoracic spine.).

A. RNAi Agent Formulations Comprising Membranous Molecular Assemblies

A RNAi agent for use in the compositions and methods of the disclosure can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the RNAi agent composition. The lipophilic material isolates the aqueous interior from an aqueous exterior, which typically does not include the RNAi agent composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the RNAi agent are delivered into the cell where the RNAi agent can specifically bind to a target RNA and can mediate RNAi. In some cases the liposomes are also specifically targeted, e.g., to direct the RNAi agent to particular cell types.

A liposome containing a RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary, a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Feigner, P. L. et al., (1987) *Proc. Natl. Acad. Sci. USA* 8:7413-7417; U.S. Pat. Nos. 4,897,355; 5,171,678; Bangham et al., (1965) *M. Mol. Biol.* 23:238; Olson et al., (1979) *Biochim. Biophys. Acta* 557:9; Szoka et al., (1978) *Proc. Natl. Acad. Sci.* 75: 4194; Mayhew et al., (1984) *Biochim. Biophys. Acta* 775:169; Kim et al., (1983) *Biochim. Biophys. Acta* 728:339; and Fukunaga et al., (1984) *Endocrinol.* 115:757. Commonly used techniques for preparing lipid aggregates of appropriate size for use as delivery vehicles include sonication and freeze-thaw plus extrusion (see, e.g., Mayer et al., (1986) *Biochim. Biophys. Acta* 858:161. Microfluidization can be used when consistently small (50 to 200 nm) and relatively uniform aggregates are desired (Mayhew et al., (1984) *Biochim. Biophys. Acta* 775:169. These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) *Biochem. Biophys. Res. Commun.,* 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) *Journal of Controlled Release,* 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid or phosphatidylcholine or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, (1994) *J. Biol. Chem.* 269:2550; Nabel, (1993) *Proc. Natl. Acad. Sci.* 90:11307; Nabel, (1992) *Human Gene Ther.* 3:649; Gershon, (1993) *Biochem.* 32:7143; and Strauss, (1992) *EMBO J.* 11:417.

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) *FEBS Letters,* 223:42; Wu et al., (1993) *Cancer Research,* 53:3765).

Various liposomes comprising one or more glycolipids are known in the art. Papahadjopoulos et al. (*Ann. N.Y. Acad. Sci.,* (1987), 507:64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.,* (1988), 85:6949). U.S. Pat. No. 4,837,028 and WO 88/04924 disclose liposomes comprising (1) sphingomyelin and (2) the ganglioside GM1 or a galactocerebroside sulfate ester. U.S. Pat. No. 5,543,152 discloses liposomes comprising sphingomyelin. Liposomes comprising 1,2-sn-dimyristoylphosphatidylcholine are disclosed in WO 97/13499.

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Feigner, P. L. et al., (1987) *Proc. Natl. Acad. Sci. USA* 8:7413-7417, and U.S. Pat. No. 4,897,355).

A DOTMA analogue, 1,2-bis(oleoyloxy)-3-(trimethylammonia)propane (DOTAP) can be used in combination with a phospholipid to form DNA-complexing vesicles. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Indiana) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wisconsin) and dipalmitoylphosphatidylethanolamine 5-carboxyspermylamide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., (1991) *Biochim. Biophys. Res. Commun.* 179:280). Lipopolylysine, made by conjugating polylysine to DOPE, has been reported to be effective for transfection in the presence of serum (Zhou, X. et al., (1991) *Biochim. Biophys. Acta* 1065:8). For certain cell lines, these liposomes containing conjugated cationic lipids, are said to exhibit lower toxicity and provide more efficient transfection than the DOTMA-containing compositions. Other cationic lipids suitable for the delivery of oligonucleotides are described in WO 98/39359 and WO 96/37194.

Liposomes that include RNAi agents can be made highly deformable. Such deformability can enable the liposomes to penetrate through pore that are smaller than the average radius of the liposome. For example, transfersomes are a type of deformable liposomes. Transfersomes can be made by adding surface edge activators, usually surfactants, to a standard liposomal composition. Transfersomes that include RNAi agent can be delivered, for example, subcutaneously by injection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present disclosure are described for example, in WO2008042973.

Surfactants find wide application in formulations such as those described herein, particularly in emulsions (including microemulsions) and liposomes. The most common way of classifying and ranking the properties of the many different types of surfactants, both natural and synthetic, is via the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The RNAi agent for use in the methods of the disclosure can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Lipid Particles

RNAi agents, e.g., dsRNAs of in the disclosure may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in WO00/03683. The particles of the present disclosure typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present disclosure are resistant in aqueous solution to degradation with a nuclease. Nucleic acid-lipid particles and their method of preparation are disclosed in, e.g., U.S. Pat. Nos.

5,976,567; 5,981,501; 6,534,484; 6,586,410; and 6,815,432; US 2010/0324120 and WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the disclosure.

Certain specific LNP formulations for delivery of RNAi agents have been described in the art, including, e.g., "LNP01" formulations as described in, e.g., WO 2008/042973, which is hereby incorporated by reference.

Additional exemplary lipid-dsRNA formulations are identified in the table below.

TABLE 6

| | | Exemplary lipid formulations | |
| --- | --- | --- |
| | Ionizable/Cationic Lipid | cationic lipid/non-cationic lipid/cholesterol/PEG-lipid conjugate Lipid:siRNA ratio |
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |

TABLE 6-continued

| | Ionizable/Cationic Lipid | cationic lipid/non-cationic lipid/cholesterol/PEG-lipid conjugate Lipid:siRNA ratio |
|---|---|---|
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine

DPPC: dipalmitoylphosphatidylcholine

PEG-DMG: PEG-didimyristoyl glycerol (C14-PEG, or PEG-C14) (PEG with avg mol wt of 2000)

PEG-DSG: PEG-distyryl glycerol (C18-PEG, or PEG-C18) (PEG with avg mol wt of 2000)

PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in WO2009/127060.

XTC comprising formulations are described in WO 2010/088537.

MC3 comprising formulations are described, e.g., in US 2010/0324120.

ALNY-100 comprising formulations are described in WO 2010/054406.

C12-200 comprising formulations are described in WO 2010/129709

Compositions and formulations for oral administration include powders or granules, microparticulates, nanoparticulates, suspensions, or solutions in water or non-aqueous media, capsules, gel capsules, sachets, tablets, or minitablets. Thickeners, flavoring agents, diluents, emulsifiers, dispersing aids, or binders can be desirable. In some embodiments, oral formulations are those in which dsRNAs featured in the disclosure are administered in conjunction with one or more penetration enhancer surfactants and chelators. Suitable surfactants include fatty acids or esters or salts thereof, bile acids or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate, and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. dsRNAs featured in the disclosure can be delivered orally, in granular form including sprayed dried particles, or complexed to form micro or nanoparticles. DsRNA complexing agents include poly-amino acids; polyimines; polyacrylates; poly-alkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US20030027780, and U.S. Pat. No. 6,747,014.

Compositions and formulations for parenteral, intraparenchymal (into the brain), intrathecal, intraventricular, or intrahepatic administration can include sterile aqueous solutions which can also contain buffers, diluents, and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the brain when treating ATXN3-associated diseases or disorders.

The pharmaceutical formulations of the present disclosure, which can conveniently be presented in unit dosage form, can be prepared according to conventional techniques well known in the pharmaceutical industry. Such techniques include the step of bringing into association the active ingredients with the pharmaceutical carrier(s) or excipient(s).

The compositions of the present disclosure can be formulated as suspensions in aqueous, non-aqueous or mixed media. Aqueous suspensions can further contain substances which increase the viscosity of the suspension including, for example, sodium carboxymethylcellulose, sorbitol, or dextran. The suspension can also contain stabilizers.

Additional Formulations i. Emulsions

The compositions of the present disclosure can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise, a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich NG., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199).

Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Since emulsions often contain a number of ingredients such as carbohydrates, proteins, sterols, and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid.

Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral, and parenteral routes and methods for their manufacture have been reviewed in the literature (see e.g., Ansel's Pharmaceutical Dosage Forms and Drug Delivery Systems, Allen, L V., Popovich NG., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich NG., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present disclosure, the compositions of RNAi agents and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich NG., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically, microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant, and electrolyte. Whether the microemulsion is of the water-in-oil (w/o) or an oil-in-water (o/w) type is dependent on the properties of the oil and surfactant used, and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich NG., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij® 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sesquioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex® 300, Captex® 355, Capmul® MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils, and silicone oil.

Microemulsions of the present disclosure can also contain additional components and additives such as sorbitan monostearate (Grill 3), Labrasol®, and penetration enhancers to improve the properties of the formulation and to enhance the absorption of the RNAi agents and nucleic acids of the present disclosure. Penetration enhancers used in the microemulsions of the present disclosure can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the disclosure may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present disclosure employs various penetration enhancers to effect the efficient delivery of nucleic acids, particularly RNAi agents, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of RNAi agents through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, NY, 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, C1-20 alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, MA, 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, NY, 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, NY, 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present disclosure, can be defined as compounds that remove metallic ions from solution by forming complexes therewith, with the result that absorption of RNAi agents through the mucosa is enhanced. With regards to their use as penetration enhancers in the present disclosure, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, MA, 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of RNAi agents through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of RNAi agents at the cellular level can also be added to the pharmaceutical and other compositions of the present disclosure. For example, cationic lipids, such as lipofectin (Junichi et al, U.S. Pat. No. 5,705,188), cationic glycerol derivatives, and polycationic molecules, such as polylysine (WO 97/30731), are also known to enhance the cellular uptake of dsRNAs.

Other agents can be utilized to enhance the penetration of the administered nucleic acids, including glycols such as ethylene glycol and propylene glycol, pyrrols such as 2-pyrrol, azones, and terpenes such as limonene and menthone.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient is selected, with the planned manner of administration in mind. Suitable pharmaceutically acceptable excipients include, but are not limited to, water, salt solutions, alcohol, polyethylene glycols, and the like.

vii. Other Components

The compositions of the present disclosure can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present disclosure, such as preservatives, antioxidants, and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, and the like which do not deleteriously interact with the nucleic acid(s) of the formulation.

In some embodiments, pharmaceutical compositions featured in the disclosure include (a) one or more RNAi agents and (b) one or more agents which function by a non-RNAi mechanism and which are useful in treating an ATXN3-associated disorder. Examples of such agents include, but are not limited to, symptomatic treatments that may include depression, sleep disorders, parkinsonism, dystonia, cramps, and pain.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

In addition to their administration, as discussed above, the RNAi agents featured in the disclosure can be administered in combination with other known agents effective in treatment of pathological processes mediated by ATXN3 with a trinucleotide expansion expression.

VIII. Kits

In certain aspects, the instant disclosure provides kits that include a suitable container containing a pharmaceutical formulation of a siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof). In certain embodiments the individual components of the pharmaceutical formulation may be provided in one container. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

IX. Methods for Inhibiting ATXN3 Expression

The present disclosure also provides methods of inhibiting expression of an ATXN3 gene in a cell. The methods include contacting a cell with an RNAi agent, e.g., double-stranded RNAi agent, in an amount effective to inhibit expression of ATXN3 in the cell, thereby inhibiting expression of ATXN3 in the cell. In certain embodiments of the disclosure, ATXN3 is inhibited preferentially in CNS (e.g., brain) cells.

Contacting of a cell with a RNAi agent, e.g., a double-stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible.

Contacting a cell may be direct or indirect, as discussed above. Furthermore, contacting a cell may be accomplished via a targeting ligand, including any ligand described herein or known in the art.

The term "inhibiting," as used herein, is used interchangeably with "reducing," "silencing," "downregulating," "suppressing" and other similar terms, and includes any level of inhibition. In certain embodiments, a level of inhibition, e.g., for a RNAi agent of the instant disclosure, can be assessed in cell culture conditions, e.g., wherein cells in cell culture are transfected via Lipofectamine™-mediated transfection at a concentration in the vicinity of a cell of 10 nM or less, 1 nM or less, etc. Knockdown of a given RNAi agent can be determined via comparison of pre-treated levels in cell culture versus post-treated levels in cell culture, optionally also comparing against cells treated in parallel with a scrambled or other form of control RNAi agent. Knockdown in cell culture of, preferably 50% or more, using the in vitro assay with human Be(2)c at a 10 nM concentration of the RNA agent with an appropriate siRNA control not targeted to ATXN3 and the PCR assay as provided in the examples herein can thereby be identified as indicative of "inhibiting" or "reducing", "downregulating" or "suppressing", etc. having occurred. It is expressly contemplated that assessment of targeted mRNA or encoded protein levels (and therefore an extent of "inhibiting", etc. caused by a RNAi agent of the disclosure) can also be assessed in in vivo systems for the RNAi agents of the instant disclosure, under properly controlled conditions as described in the art.

The phrase "inhibiting expression of an ATXN3," as used herein, includes inhibition of expression of any ATXN3 gene (such as, e.g., a mouse ATXN3 gene, a rat ATXN3 gene, a monkey ATXN3 gene, or a human ATXN3 gene) as well as variants or mutants of an ATXN3 gene that encode an ATXN3 protein. Thus, the ATXN3 gene may be a wild-type ATXN3 gene, a mutant ATXN3 gene, or a transgenic ATXN3 gene in the context of a genetically manipulated cell, group of cells, or organism.

"Inhibiting expression of an ATXN3 gene" includes any statistically significant level of inhibition of an ATXN3 gene, e.g., at least partial suppression of the expression of an ATXN3 gene, such as an inhibition by at least 20%. In certain embodiments, inhibition is by at least 30%, 40%, preferably at least 50%, 60%, 70%, 80%, 85%, 90%, 95%, 96%, 97%, 98%, or 99%; or to below the level of detection of the assay method. It is understood that in vivo, the level of expression may be reduced in a certain subject sample, e.g., in one or more regions of the brain, but not reduced in another subject sample, e.g., blood or serum derived therefrom. In certain embodiments, inhibition of expression is the expression level relative to the expression level prior to the first dose of the RNAi agent. In certain embodiments, the level of expression may be determined after multiple doses of the RNAi agent.

The expression of an ATXN3 gene may be assessed based on the level of any variable associated with ATXN3 gene expression, e.g., ATXN3 mRNA level or ATXN3 protein level.

Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the disclosure, expression of an ATXN3 gene is inhibited by at least 20%, 30%, 40%, preferably at least 50%, 60%, 70%, 80%, 85%, 90%, or 95%, or to below the level of detection of the assay. In certain embodiments, the methods include a clinically relevant inhibition of expression of ATXN3, e.g. as demonstrated by a clinically relevant outcome after treatment of a subject with an agent to reduce the expression of ATXN3.

Inhibition of the expression of an ATXN3 gene may be manifested by a reduction of the amount of mRNA expressed by a first cell or group of cells (such cells may be present, for example, in a sample derived from a subject) in which an ATXN3 gene is transcribed and which has or have been treated (e.g., by contacting the cell or cells with a RNAi agent of the disclosure, or by administering a RNAi agent of the disclosure to a subject in which the cells are or were present) such that the expression of an ATXN3 gene is inhibited, as compared to a second cell or group of cells substantially identical to the first cell or group of cells but which has not or have not been so treated (control cell(s) not treated with a RNAi agent or not treated with a RNAi agent targeted to the gene of interest). The degree of inhibition may be expressed in terms of:

$$\frac{(mRNA \text{ in control cells}) - (mRNA \text{ in treated cells})}{(mRNA \text{ in control cells})} \cdot 100\%$$

In other embodiments, inhibition of the expression of an ATXN3 gene may be assessed in terms of a reduction of a parameter that is functionally linked to ATXN3 gene expression, e.g., ATXN3 protein expression. ATXN3 gene silencing may be determined in any cell expressing ATXN3, either endogenous or heterologous from an expression construct, and by any assay known in the art.

Inhibition of the expression of an ATXN3 protein may be manifested by a reduction in the level of the ATXN3 protein that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of an ATXN3 gene includes a cell or group of cells that has not yet been contacted with a RNAi agent of the disclosure. For example, the control cell or group of cells may be derived from an individual subject (e.g., a human or animal subject) prior to treatment of the subject with an RNAi agent.

The level of ATXN3 mRNA that is expressed by a cell or group of cells may be determined using any method known in the art for assessing mRNA expression. In one embodiment, the level of expression of ATXN3 in a sample is determined by detecting a transcribed polynucleotide, or portion thereof, e.g., mRNA of the ATXN3 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Circulating ATXN3 mRNA may be detected using methods the described in WO2012/177906, the methods of which are hereby incorporated herein by reference.

In some embodiments, the level of expression of ATXN3 is determined using a nucleic acid probe. The term "probe", as used herein, refers to any molecule that is capable of selectively binding to a specific ATXN3 nucleic acid or protein; or fragment thereof. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to ATXN3 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of ATXN3 mRNA.

An alternative method for determining the level of expression of ATXN3 in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self-sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the disclosure, the level of expression of ATXN3 is determined by quantitative fluorogenic RT-PCR (i.e., the TaqMan™ System), by a Dual-Glo® Luciferase assay, or by other art-recognized method for measurement of ATXN3 expression or mRNA level.

The expression levels of ATXN3 mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195, and 5,445,934, which are incorporated herein by reference for the methods provided therein. The determination of ATXN3 expression level may also comprise using nucleic acid probes in solution.

In some embodiments, the level of mRNA expression is assessed using branched DNA (bDNA) assays or real time PCR (qPCR). The use of this PCR method is described and exemplified in the Examples presented herein.

The level of ATXN3 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like. Such assays can also be used for the detection of proteins indicative of the presence or replication of ATXN3 proteins.

In some embodiments, the efficacy of the methods of the disclosure in the treatment of an ATXN3-related disease is assessed by a decrease in ATXN3 mRNA level (e.g, by assessment of a CSF sample for ATXN3 levels, by brain biopsy, or otherwise).

In some embodiments of the methods of the disclosure, the RNAi agent is administered to a subject such that the RNAi agent is delivered to a specific site within the subject. The inhibition of expression of ATXN3 may be assessed using measurements of the level or change in the level of ATXN3 mRNA or ATXN3 protein in a sample derived from a specific site within the subject, e.g., CNS cells, CSF. In certain embodiments, the methods include a clinically relevant inhibition of expression of ATXN3, e.g. as demonstrated by a clinically relevant outcome after treatment of a subject with an agent to reduce the expression of ATXN3.

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

X. Methods of Treating or Preventing ATXN3-Associated Diseases

The present disclosure also provides methods of using a RNAi agent of the disclosure or a composition containing a RNAi agent of the disclosure to reduce or inhibit ATXN3 expression in a cell. The methods include contacting the cell with a dsRNA of the disclosure and maintaining the cell for a time sufficient to obtain degradation of the mRNA transcript of an ATXN3 gene, thereby inhibiting expression of the ATXN3 gene in the cell. Reduction in gene expression can be assessed by any methods known in the art. For example, a reduction in the expression of ATXN3 may be determined by determining the mRNA expression level of ATXN3 using methods provided above.

In the methods of the disclosure the cell may be contacted in vitro or in vivo, i.e., the cell may be within a subject.

A cell suitable for treatment using the methods of the disclosure may be any cell that expresses an ATXN3 gene. A cell suitable for use in the methods of the disclosure may be a mammalian cell, e.g., a primate cell (such as a human cell or a non-human primate cell, e.g., a monkey cell or a chimpanzee cell), a non-primate cell (such as a rat cell, or a mouse cell. In one embodiment, the cell is a human cell, e.g., a human CNS cell.

ATXN3 expression is inhibited in the cell by at least about 30, 40%, 50%, 55%, 60%, 65%, 70%, 75%, 80%, 85%, 90%, 95%, or about 100%, i.e., to below the level of detection. In preferred embodiments, ATXN3 expression is inhibited by at least 50%.

The in vivo methods of the disclosure may include administering to a subject a composition containing a RNAi agent, where the RNAi agent includes a nucleotide sequence that is complementary to at least a part of an RNA transcript of the ATXN3 gene of the mammal to be treated. When the organism to be treated is a mammal such as a human, the composition can be administered by any means known in the art including, but not limited to oral, intraperitoneal, or parenteral routes, including intracranial (e.g., intraventricular, intraparenchymal, intracranial, and intrathecal), intravenous, intramuscular, intravitreal, subcutaneous, transdermal, airway (aerosol), nasal, rectal, and topical (including buccal and sublingual) administration. In certain embodiments, the compositions are administered by intrathecal injection. In certain embodiments, the compositions are administered by intraventricular injection. In certain embodiments, the compositions are administered by intracranial injection.

In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of ATXN3, or a therapeutic or prophylactic effect.

In some embodiments, the administration is via a pump. The pump may be an external pump or a surgically implanted pump. In other embodiments, the pump is an infusion pump. An infusion pump may be used for intracranial, intravenous, or epidural infusions. In certain embodiments, the pump is a surgically implanted pump that delivers the RNAi agent to the CNS.

The mode of administration may be chosen based upon whether local or systemic treatment is desired and based upon the area to be treated. The route and site of administration may be chosen to enhance targeting.

In one aspect, the present disclosure also provides methods for inhibiting the expression of an ATXN3 gene in a mammal. The methods include administering to the mammal a composition comprising a dsRNA that targets an ATXN3 gene in a cell of the mammal and maintaining the mammal for a time sufficient to obtain degradation of the mRNA transcript of the ATXN3 gene, thereby inhibiting expression of the ATXN3 gene in the cell. Reduction in gene expression can be assessed by any methods described herein. In one embodiment, a CNS biopsy sample or a cerebrospinal fluid (CSF) sample serves as the tissue material for monitoring the reduction in ATXN3 gene or protein expression (or of a proxy therefore).

The present disclosure further provides methods of treatment of a subject in need thereof. The treatment methods of the disclosure include administering a RNAi agent of the disclosure to a subject, e.g., a subject that would benefit from inhibition of ATXN3 expression, in a therapeutically effective amount of a RNAi agent targeting an ATXN3 gene or a pharmaceutical composition comprising a RNAi agent targeting an ATXN3 gene.

In addition, the present disclosure provides methods of preventing, treating or inhibiting the progression of an ATXN3-associated disease or disorder (i.e., SCA3) in a subject, such as the progression of an ATXN3-associated disease or disorder as characterized by clinical features including, but not limited to, ataxia, spasticity, rigidity, bradykinesia, dysarthria, spastic paraplegia, peripheral polyneuropathy, and parkinsonism-like symptoms. The methods include administering to the subject a therapeutically effective amount of any of the dsRNAs or the pharmaceutical composition provided herein, thereby preventing, treating or inhibiting the progression of an ATXN3-associated disease or disorder in the subject.

A RNAi agent of the disclosure may be administered as a "free RNAi agent." A free RNAi agent is administered in the absence of a pharmaceutical composition. The naked RNAi agent may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the RNAi agent can be adjusted such that it is suitable for administering to a subject.

Alternatively, a RNAi agent of the disclosure may be administered as a pharmaceutical composition, such as a dsRNA liposomal formulation.

Subjects that would benefit from a reduction or inhibition of ATXN3 gene expression are those having an ATXN3-associated disorder.

The disclosure further provides methods for the use of a RNAi agent or a pharmaceutical composition thereof, e.g., for treating a subject that would benefit from reduction or inhibition of ATXN3 expression, e.g., a subject having an ATXN3-associated disorder, in combination with other pharmaceuticals or other therapeutic methods, e.g., with known pharmaceuticals or known therapeutic methods, such as, for example, those which are currently employed for treating these disorders. For example, in certain embodiments, a RNAi agent targeting ATXN3 is administered in combination with, e.g., an agent useful in treating an ATXN3-associated disorder as described elsewhere herein or as otherwise known in the art. For example, additional agents suitable for treating a subject that would benefit from reduction in ATXN3 expression, e.g., a subject having an ATXN3-associated disorder, may include agents currently used to treat symptoms of ATXN3. Non-limiting examples of such agents may include symptomatic treatments for Parkinsonism-like symptoms (levodopa or dopamine agonists), psychostimulants to improve daytime fatigue (modafinil), mexiletine or carbamazepine for cramps. The RNAi agent and additional therapeutic agents may be administered at the same time or in the same combination, e.g., intrathecally, or the additional therapeutic agent can be administered as part of a separate composition or at separate times or by another method known in the art or described herein.

In one embodiment, the method includes administering a composition featured herein such that expression of the target ATXN3 gene is decreased, for at least one month. In preferred embodiments, expression is decreased for at least 2 months, 3 months, or 6 months.

Preferably, the RNAi agents useful for the methods and compositions featured herein specifically target RNAs (primary or processed) of the target ATXN3 gene. Compositions and methods for inhibiting the expression of these genes using RNAi agents can be prepared and performed as described herein.

Administration of the dsRNA according to the methods of the disclosure may result in a reduction of the severity, signs, symptoms, or markers of such diseases or disorders in a patient with an ATXN3-associated disorder. By "reduction" in this context is meant a statistically significant or clinically significant decrease in such level. The reduction can be, for example, at least 10%, 15%, 20%, 25%, 30%, 35%, 40%, 45%, 50%, 55%, 60%, 65%, 70%, 75%, 80%, 85%, 90%, or 95%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of an ATXN3-associated disorder may be assessed, for example, by periodic monitoring of a subject's performance on the Scale for the Assessment and Rating of Ataxia (SARA), Composite Cerebellar Functional Severity Score (CCFS), Spinocerebellar ataxia Functional Index (SCAFI), Inventory of Non-Ataxia Signs (INAS) which provide non-ataxia signs in ataxia patients, and other scales that are appropriate for movement disorders. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of a RNAi agent targeting ATXN3 or pharmaceutical composition thereof, "effective against" an ATXN3-associated disorder indicates that administration in a clinically appropriate manner results in a beneficial effect for at least a statistically significant fraction of patients, such as an improvement of symptoms, a cure, a reduction in disease, extension of life, improvement in quality of life, or other effect generally recognized as positive by medical doctors familiar with treating ATXN3-associated disorders and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given RNAi agent drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale, as but one example the Scale for the Assessment and Rating of Ataxia (SARA). Any positive change resulting in e.g., lessening of severity of disease measured using the appropriate scale, represents adequate treatment using a RNAi agent or RNAi agent formulation as described herein.

Subjects can be administered a therapeutic amount of dsRNA, such as about 0.01 mg/kg to about 200 mg/kg.

The RNAi agent can be administered intrathecally, via intravitreal injection, or by intravenous infusion over a period of time, on a regular basis. In certain embodiments, after an initial treatment regimen, the treatments can be administered on a less frequent basis. Administration of the RNAi agent can reduce ATXN3 levels, e.g., in a cell, tissue, blood, CSF sample or other compartment of the patient by at least 20%, 30%, 40%, 50%, 55%, 60%, 65%, 70%, 75%, 80%, 85%, 90%, or 95%. In a preferred embodiment, administration of the RNAi agent can reduce ATXN3 levels, e.g., in a cell, tissue, blood, CSF sample or other compartment of the patient by at least 50%.

Unless otherwise defined, all technical and scientific terms used herein have the same meaning as commonly understood by one of ordinary skill in the art to which this invention belongs. Although methods and materials similar or equivalent to those described herein can be used in the practice or testing of the RNAi agents and methods featured in the invention, suitable methods and materials are described below. All publications, patent applications, patents, and other references mentioned herein are incorporated by reference in their entirety. In case of conflict, the present specification, including definitions, will control. In the event of a discrepancy between the recited positions of the duplexes presented herein and the alignment of the duplexes to the recited sequences, the alignment of the duplexes to the recited sequence will govern. In addition, the materials, methods, and examples are illustrative only and not intended to be limiting.

SPECIFIC EMBODIMENTS

1. A double-stranded ribonucleic acid (dsRNA) agent for inhibiting expression sodium channel, voltage gated, type IX alpha subunit (ATXN3), wherein the dsRNA agent comprises a sense strand and an antisense strand forming a double-stranded region, wherein the sense strand comprises a nucleotide sequence comprising at least 15 contiguous nucleotides, with 0, 1, 2, or 3 mismatches, of a portion of a coding strand of human ATXN3 and the antisense strand comprises a nucleotide sequence comprising at least 15 contiguous nucleotides, with 0, 1, 2, or 3 mismatches, of the corresponding portion of a non-coding strand of human ATXN3 such that the sense strand is complementary to the at least 15 contiguous nucleotides in the antisense strand.

2. The dsRNA agent of embodiment 1, wherein the coding strand of human ATXN3 comprises the sequence SEQ ID NO: 1.

3. The dsRNA agent of embodiment 1 or 2, wherein the non-coding strand of human ATXN3 comprises the sequence of SEQ ID NO: 2.

4 The dsRNA agent of embodiment 1, wherein the coding strand of human ATXN3 comprises the sequence SEQ ID NO: 1918.

5. The dsRNA agent of embodiment 1 or 4, wherein the non-coding strand of human ATXN3 comprises the sequence of SEQ ID NO: 1919.

6. A double-stranded ribonucleic acid (dsRNA) agent for inhibiting expression of ATXN3, wherein the dsRNA agent comprises a sense strand and an antisense strand forming a double-stranded region, wherein the antisense strand comprises a nucleotide sequence comprising at least 15 contiguous nucleotides, with 0, 1, 2, or 3 mismatches, of a portion of nucleotide sequence of SEQ ID NO: 2 such that the sense strand is complementary to the at least 15 contiguous nucleotides in the antisense strand.

7. The dsRNA agent of embodiment 6, wherein the sense strand comprises a nucleotide sequence comprising at least 15 contiguous nucleotides, with 0, or 1, 2, or 3 mismatches, of the corresponding portion of the nucleotide sequence of SEQ ID NO: 1.

8. A double-stranded ribonucleic acid (dsRNA) agent for inhibiting expression of ATXN3, wherein the dsRNA agent comprises a sense strand and an antisense strand forming a double-stranded region, wherein the antisense strand comprises a nucleotide sequence comprising at least 15 contiguous nucleotides, with 0, 1, 2, or 3 mismatches, of a portion of nucleotide sequence of SEQ ID NO: 1919 such that the sense strand is complementary to the at least 15 contiguous nucleotides in the antisense strand.

9. The dsRNA agent of embodiment 8, wherein the sense strand comprises a nucleotide sequence comprising at least 15 contiguous nucleotides, with 0, or 1, 2, or 3 mismatches, of the corresponding portion of the nucleotide sequence of SEQ ID NO: 1918.

10. The dsRNA of any of the preceding embodiments, wherein the dsRNA agent comprises a sense strand and an antisense strand, wherein the antisense strand comprises a nucleotide sequence comprising at least 17 contiguous nucleotides, with 0, 1, 2, or 3 mismatches, of a portion of nucleotide sequence of SEQ ID NO: 2 such that the sense strand is complementary to the at least 17 contiguous nucleotides in the antisense strand.

11. The dsRNA of embodiment 10, wherein the sense strand comprises a nucleotide sequence comprising at least 17 contiguous nucleotides, with 0, or 1, 2, or 3 mismatches, of the corresponding portion of the nucleotide sequence of SEQ ID NO: 1.

12. The dsRNA of any of the preceding embodiments, wherein the dsRNA agent comprises a sense strand and an antisense strand, wherein the antisense strand comprises a nucleotide sequence comprising at least 17 contiguous nucleotides, with 0, 1, 2, or 3 mismatches, of a portion of nucleotide sequence of SEQ ID NO: 1919 such that the sense strand is complementary to the at least 17 contiguous nucleotides in the antisense strand.

13. The dsRNA of embodiment 12, wherein the sense strand comprises a nucleotide sequence comprising at least 17 contiguous nucleotides, with 0, or 1, 2, or 3 mismatches, of the corresponding portion of the nucleotide sequence of SEQ ID NO: 1918.

14. The dsRNA of any of the preceding embodiments, wherein the dsRNA agent comprises a sense strand and an antisense strand, wherein the antisense strand comprises a nucleotide sequence comprising at least 19 contiguous nucleotides, with 0, 1, 2, or 3 mismatches, of a portion of nucleotide sequence of SEQ ID NO: 2 such that the sense strand is complementary to the at least 19 contiguous nucleotides in the antisense strand.

15. The dsRNA of embodiment 14, wherein the sense strand comprises a nucleotide sequence comprising at least 19 contiguous nucleotides, with 0, 1, 2, or 3 mismatches, of the corresponding portion of the nucleotide sequence of SEQ ID NO: 1.

16. The dsRNA of any of the preceding embodiments, wherein the dsRNA agent comprises a sense strand and an antisense strand, wherein the antisense strand comprises a nucleotide sequence comprising at least 19 contiguous nucleotides, with 0, 1, 2, or 3 mismatches, of a portion of nucleotide sequence of SEQ ID NO: 1919 such that the sense strand is complementary to the at least 19 contiguous nucleotides in the antisense strand.

17. The dsRNA of embodiment 16, wherein the sense strand comprises a nucleotide sequence comprising at least 19 contiguous nucleotides, with 0, 1, 2, or 3 mismatches, of the corresponding portion of the nucleotide sequence of SEQ ID NO: 1918.

18. The dsRNA of any of the preceding embodiments, wherein the dsRNA agent comprises a sense strand and an antisense strand, wherein the antisense strand comprises a nucleotide sequence comprising at least 21 contiguous nucleotides, with 0, 1, 2, or 3 mismatches, of a portion of nucleotide sequence of SEQ ID NO: 2 such that the sense strand is complementary to the at least 21 contiguous nucleotides in the antisense strand.

19. The dsRNA of embodiment 18, wherein the sense strand comprises a nucleotide sequence comprising at least 21 contiguous nucleotides, with 0, or 1, 2, or 3 mismatches, of the corresponding portion of the nucleotide sequence of SEQ ID NO: 1.

20. The dsRNA of any of the preceding embodiments, wherein the dsRNA agent comprises a sense strand and an antisense strand, wherein the antisense strand comprises a nucleotide sequence comprising at least 21 contiguous nucleotides, with 0, 1, 2, or 3 mismatches, of a portion of nucleotide sequence of SEQ ID NO: 1919 such that the sense strand is complementary to the at least 21 contiguous nucleotides in the antisense strand.

21. The dsRNA of embodiment 20, wherein the sense strand comprises a nucleotide sequence comprising at least 21 contiguous nucleotides, with 0, or 1, 2, or 3 mismatches, of the corresponding portion of the nucleotide sequence of SEQ ID NO: 1918.

22. The dsRNA agent of any one of the preceding embodiments, wherein the portion of the sense strand is a portion within a sense strand in any one of Tables 2, 4A, 4B, 5, 7A, 7B, 10, 11, and 14.

23. The dsRNA agent of any one of the preceding embodiments, wherein the portion of the antisense strand is a portion within an antisense strand in any one of Tables 2, 4A, 4B, 5, 7A, 7B, 10, 11, and 14.

24. The dsRNA agent of any of the preceding embodiments, wherein the antisense strand comprises a nucleotide sequence comprising at least 15 contiguous nucleotides, with 0, 1, 2, or 3 mismatches, from one of the antisense sequences listed in any one of Tables 2, 4A, 4B, 5, 7A, 7B, 10, 11, and 14.

25. The dsRNA agent of any of the preceding embodiments, wherein the sense strand comprises a nucleotide sequence comprising at least 15 contiguous nucleotides, with 0, 1, 2, or 3 mismatches, from a sense sequence listed in any one of Tables 2, 4A, 4B, 5, 7A, 7B, 10, 11, and 14 that corresponds to the antisense sequence.

26. The dsRNA agent of any of the preceding embodiments, wherein the antisense strand comprises a nucleotide sequence comprising at least 17 contiguous nucleotides, with 0, 1, 2, or 3 mismatches, from one of the antisense sequences listed in any one of Tables 2, 4A, 4B, 5, 7A, 7B, 10, 11, and 14.

27. The dsRNA agent of any of the preceding embodiments, wherein the sense strand comprises a nucleotide sequence comprising at least 17 contiguous nucleotides, with 0, 1, 2, or 3 mismatches, from a sense sequence listed in any one of Tables 2, 4A, 4B, 5, 7A, 7B, 10, 11, and 14 that corresponds to the antisense sequence.

28. The dsRNA agent of any of the preceding embodiments, wherein the antisense strand comprises a nucleotide sequence comprising at least 19 contiguous nucleotides, with 0, 1, 2, or 3 mismatches, from one of the antisense sequences listed in any one of Tables 2, 4A, 4B, 5, 7A, 7B, 10, 11, and 14.

29. The dsRNA agent of any of the preceding embodiments, wherein the sense strand comprises a nucleotide sequence comprising at least 19 contiguous nucleotides, with 0, 1, 2, or 3 mismatches, from a sense sequence listed in any one of Tables 2, 4A, 4B, 5, 7A, 7B, 10, 11, and 14 that corresponds to the antisense sequence.

30. The dsRNA agent of any of the preceding embodiments, wherein the antisense strand comprises a nucleotide sequence comprising at least 21 contiguous nucleotides, with 0, 1, 2, or 3 mismatches, from one of the antisense sequences listed in any one of Tables 2, 4A, 4B, 5, 7A, 7B, 10, 11, and 14.

31. The dsRNA agent of any of the preceding embodiments, wherein the sense strand comprises a nucleotide sequence comprising at least 21 contiguous nucleotides, with 0, 1, 2, or 3 mismatches, from a sense sequence listed in any one of Tables 2, 4A, 4B, 5, 7A, 7B, 10, 11, and 14 that corresponds to the antisense sequence.

32. The dsRNA agent of any of the preceding embodiments, wherein the sense strand is at least 23 nucleotides in length, e.g., 23-30 nucleotides in length.

33. The dsRNA agent of any of the preceding embodiments, wherein at least one of the sense and the antisense strand is conjugated to one or more lipophilic moieties.

34. The dsRNA agent of embodiment 33, wherein the lipophilic moiety is conjugated to one or more positions in the double-stranded region of the dsRNA agent.

35. The dsRNA agent of embodiment 33 or 34, wherein the lipophilic moiety is conjugated via a linker or carrier.

36. The dsRNA agent of any one of embodiments 33-35, wherein lipophilicity of the lipophilic moiety, measured by log Kow, exceeds 0.

37. The dsRNA agent of any one of the preceding embodiments, wherein the hydrophobicity of the double-stranded RNAi agent, measured by the unbound fraction in a plasma protein binding assay of the double-stranded RNAi agent, exceeds 0.2.

38. The dsRNA agent of embodiment 37, wherein the plasma protein binding assay is an electrophoretic mobility shift assay using human serum albumin protein.

39. The dsRNA agent of any of the preceding embodiments, wherein the dsRNA agent comprises at least one modified nucleotide.

40. The dsRNA agent of embodiment 39, wherein no more than five of the sense strand nucleotides and not more than five of the nucleotides of the antisense strand are unmodified nucleotides.

41. The dsRNA agent of embodiment 39, wherein all of the nucleotides of the sense strand and all of the nucleotides of the antisense strand comprise a modification.

42. The dsRNA agent of any one of embodiments 39-41, wherein at least one of the modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a glycol modified nucleotide, and a 2-O—(N-methylacetamide) modified nucleotide; and combinations thereof.

43. The dsRNA agent of any of embodiments 39-41, wherein no more than five of the sense strand nucleotides and not more than five of the nucleotides of the antisense strand include modifications other than 2'-O-methyl modified nucleotide, a 2'-fluoro modified nucleotide, a 2'-deoxy-modified nucleotide, unlocked nucleic acids (UNA) or glycerol nucleic acid (GNA).

44. The dsRNA agent of any of the preceding embodiments, which comprises a non-nucleotide spacer (wherein optionally the non-nucleotide spacer comprises a C3-C6 alkyl) between two of the contiguous nucleotides of the sense strand or between two of the contiguous nucleotides of the antisense strand.

45. The dsRNA agent of any of the preceding embodiments, wherein each strand is no more than 30 nucleotides in length.

46. The dsRNA agent of any of the preceding embodiments, wherein at least one strand comprises a 3'-overhang of at least 1 nucleotide.

47. The dsRNA agent of any of the preceding embodiments, wherein at least one strand comprises a 3'-overhang of at least 2 nucleotides.

48. The dsRNA agent of any of the preceding embodiments, wherein the double-stranded region is 15-30 nucleotide pairs in length.

49. The dsRNA agent of embodiment 48, wherein the double-stranded region is 17-23 nucleotide pairs in length.

50. The dsRNA agent of embodiment 48, wherein the double-stranded region is 17-25 nucleotide pairs in length.

51. The dsRNA agent of embodiment 48, wherein the double-stranded region is 23-27 nucleotide pairs in length.

52. The dsRNA agent of embodiment 48, wherein the double-stranded region is 19-21 nucleotide pairs in length.

53. The dsRNA agent of embodiment 48, wherein the double-stranded region is 21-23 nucleotide pairs in length.

54. The dsRNA agent of any of the preceding embodiments, wherein each strand has 19-30 nucleotides.

55. The dsRNA agent of any of the preceding embodiments, wherein each strand has 19-23 nucleotides.

56. The dsRNA agent of any of the preceding embodiments, wherein each strand has 21-23 nucleotides.

57. The dsRNA agent of any of the preceding embodiments, wherein the agent comprises at least one phosphorothioate or methylphosphonate internucleotide linkage.

58. The dsRNA agent of embodiment 457, wherein the phosphorothioate or methylphosphonate internucleotide linkage is at the 3'-terminus of one strand.

59. The dsRNA agent of embodiment 58, wherein the strand is the antisense strand.

60. The dsRNA agent of embodiment 58, wherein the strand is the sense strand.

61. The dsRNA agent of embodiment 57, wherein the phosphorothioate or methylphosphonate internucleotide linkage is at the 5'-terminus of one strand.

62. The dsRNA agent of embodiment 61, wherein the strand is the antisense strand.

63. The dsRNA agent of embodiment 61, wherein the strand is the sense strand.

64. The dsRNA agent of embodiment 57, wherein each of the 5'- and 3'-terminus of one strand comprises a phosphorothioate or methylphosphonate internucleotide linkage.

65. The dsRNA agent of embodiment 64, wherein the strand is the antisense strand.

66. The dsRNA agent of any of the preceding embodiments, wherein the base pair at the 1 position of the 5'-end of the antisense strand of the duplex is an AU base pair.

67. The dsRNA agent of embodiment 64, wherein the sense strand has a total of 21 nucleotides and the antisense strand has a total of 23 nucleotides.

68. The dsRNA agent of any one of embodiments 33-67, wherein one or more lipophilic moieties are conjugated to one or more internal positions on at least one strand.

69. The dsRNA agent of embodiment 68, wherein the one or more lipophilic moieties are conjugated to one or more internal positions on at least one strand via a linker or carrier.

70. The dsRNA agent of embodiment 69, wherein the internal positions include all positions except the terminal two positions from each end of the at least one strand.

71. The dsRNA agent of embodiment 69, wherein the internal positions include all positions except the terminal three positions from each end of the at least one strand. 72. The dsRNA agent of any one of embodiments 69-71, wherein the internal positions exclude a cleavage site region of the sense strand.

73. The dsRNA agent of embodiment 72, wherein the internal positions include all positions except positions 9-12, counting from the 5'-end of the sense strand.

74. The dsRNA agent of embodiment 72, wherein the internal positions include all positions except positions 11-13, counting from the 3'-end of the sense strand.

75. The dsRNA agent of any one of embodiments 69-71, wherein the internal positions exclude a cleavage site region of the antisense strand.

76. The dsRNA agent of embodiment 75, wherein internal positions include all positions except positions 12-14, counting from the 5'-end of the antisense strand.

77. The dsRNA agent of any one of embodiments 69-71, wherein the internal positions include all positions except positions 11-13 on the sense strand, counting from the 3'-end, and positions 12-14 on the antisense strand, counting from the 5'-end.

78. The dsRNA agent of any one of embodiments 33-77, wherein the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand.

79. The dsRNA agent of embodiment 78, wherein the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

80. The dsRNA agent of embodiment 34, wherein the positions in the double-stranded region excludes a cleavage site region of the sense strand.

81. The dsRNA agent of any one of embodiments 33-80, wherein the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand.

82. The dsRNA agent of embodiment 81, wherein the lipophilic moiety is conjugated to position 21, position 20, position 15, position 1, or position 7 of the sense strand.

83. The dsRNA agent of embodiment 81, wherein the lipophilic moiety is conjugated to position 21, position 20, or position 15 of the sense strand.

84. The dsRNA agent of embodiment 81, wherein the lipophilic moiety is conjugated to position 20 or position 15 of the sense strand.

85. The dsRNA agent of embodiment 81, wherein the lipophilic moiety is conjugated to position 16 of the antisense strand.

86. The dsRNA agent of embodiment 81, wherein the lipophilic moiety is conjugated to position 6, counting from the 5'-end of the sense strand.

87. The dsRNA agent of any one of embodiments 33-86, wherein the lipophilic moiety is an aliphatic, alicyclic, or polyalicyclic compound.

88. The dsRNA agent of embodiment 87, wherein the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine.

89. The dsRNA agent of embodiment 88, wherein the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

90. The dsRNA agent of embodiment 89, wherein the lipophilic moiety contains a saturated or unsaturated C6-C18 hydrocarbon chain.

91. The dsRNA agent of embodiment 89, wherein the lipophilic moiety contains a saturated or unsaturated C16 hydrocarbon chain.

92. The dsRNA agent of any one of embodiments 33-91, wherein the lipophilic moiety is conjugated via a carrier that replaces one or more nucleotide(s) in the internal position(s) or the double-stranded region.

93. The dsRNA agent of embodiment 92, wherein the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

94. The dsRNA agent of any one of embodiments 33-91, wherein the lipophilic moiety is conjugated to the double-stranded iRNA agent via a linker containing an ether, thioether, urea, carbonate, amine, amide, maleimide-thio-ether, disulfide, phosphodiester, sulfonamide linkage, a product of a click reaction, or carbamate.

95. The double-stranded iRNA agent of any one of embodiments 33-94, wherein the lipophilic moiety is con-jugated to a nucleobase, sugar moiety, or internucleosidic linkage.

96. The dsRNA agent of any one of embodiments 33-95, wherein the lipophilic moiety or targeting ligand is conju-gated via a bio-cleavable linker selected from the group consisting of DNA, RNA, disulfide, amide, functionalized monosaccharides or oligosaccharides of galactosamine, glu-cosamine, glucose, galactose, mannose, and combinations thereof.

97. The dsRNA agent of any one of embodiments 33-96, wherein the 3'-end of the sense strand is protected via an end cap which is a cyclic group having an amine, said cyclic group being selected from the group consisting of pyrro-lidinyl, pyrazolinyl, pyrazolidinyl, imidazolinyl, imidazo-lidinyl, piperidinyl, piperazinyl, [1,3]dioxolanyl, oxazolidi-nyl, isoxazolidinyl, morpholinyl, thiazolidinyl, isothiazolidinyl, quinoxalinyl, pyridazinonyl, tetrahydro-furanyl, and decalinyl.

98. The dsRNA agent of any one of embodiments 33-97, further comprising a targeting ligand, e.g., a ligand that targets a CNS tissue or a liver tissue.

99. The dsRNA agent of embodiment 98, wherein the CNS tissue is a brain tissue or a spinal tissue.

100. The dsRNA agent of embodiment 98, wherein the targeting ligand is a GalNAc conjugate.

101. The dsRNA agent of any one of embodiments 1-100, further comprising a terminal, chiral modification occurring at the first internucleotide linkage at the 3'-end of the antisense strand, having the linkage phosphorus atom in Sp configuration, a terminal, chiral modification occurring at the first inter-nucleotide linkage at the 5'-end of the antisense strand, having the linkage phosphorus atom in Rp configura-tion, and a terminal, chiral modification occurring at the first inter-nucleotide linkage at the 5'-end of the sense strand, having the linkage phosphorus atom in either Rp con-figuration or Sp configuration.

102. The dsRNA agent of any one of embodiments 1-100, further comprising a terminal, chiral modification occurring at the first and second internucleotide linkages at the 3'-end of the antisense strand, having the linkage phosphorus atom in Sp configuration, a terminal, chiral modification occurring at the first inter-nucleotide linkage at the 5'-end of the antisense strand, having the linkage phosphorus atom in Rp configura-tion, and a terminal, chiral modification occurring at the first inter-nucleotide linkage at the 5'-end of the sense strand, having the linkage phosphorus atom in either Rp or Sp configuration.

103. The dsRNA agent of any one of embodiments 1-100, further comprising a terminal, chiral modification occurring at the first, second and third internucleotide linkages at the 3'-end of the antisense strand, having the linkage phosphorus atom in Sp configuration, a terminal, chiral modification occurring at the first inter-nucleotide linkage at the 5'-end of the antisense strand, having the linkage phosphorus atom in Rp configura-tion, and a terminal, chiral modification occurring at the first inter-nucleotide linkage at the 5'-end of the sense strand, having the linkage phosphorus atom in either Rp or Sp configuration.

104. The dsRNA agent of any one of embodiments 1-100, further comprising a terminal, chiral modification occurring at the first, and second internucleotide linkages at the 3'-end of the antisense strand, having the linkage phosphorus atom in Sp configuration, a terminal, chiral modification occurring at the third internucleotide linkages at the 3'-end of the antisense strand, having the linkage phosphorus atom in Rp configuration, a terminal, chiral modification occurring at the first inter-nucleotide linkage at the 5'-end of the antisense strand, having the linkage phosphorus atom in Rp configura-tion, and a terminal, chiral modification occurring at the first inter-nucleotide linkage at the 5'-end of the sense strand, having the linkage phosphorus atom in either Rp or Sp configuration.

105. The dsRNA agent of any one of embodiments 1-100, further comprising a terminal, chiral modification occurring at the first, and second internucleotide linkages at the 3'-end of the antisense strand, having the linkage phosphorus atom in Sp configuration, a terminal, chiral modification occurring at the first, and second internucleotide linkages at the 5'-end of the antisense strand, having the linkage phosphorus atom in Rp configuration, and a terminal, chiral modification occurring at the first inter-nucleotide linkage at the 5'-end of the sense strand, having the linkage phosphorus atom in either Rp or Sp configuration.

106. The dsRNA agent of any one of embodiments 1-105, further comprising a phosphate or phosphate mimic at the 5'-end of the antisense strand.

107. The dsRNA agent of embodiment 106, wherein the phosphate mimic is a 5'-vinyl phosphonate (VP).

108. A cell containing the dsRNA agent of any one of embodiments 1-107.

109. A human cell comprising a reduced level of ATXN3 mRNA or a level of ATXN3 protein as compared to an otherwise similar untreated cell, wherein optionally the level is reduced by at least 10%, 15%, 20%, 25%, 30%, 35%, 40%, 45%, 50%, 55%, 60%, 65%, 70%, 75%, 80%, 85%, 90%, or 95%.

110. The human cell of embodiment 109, which was produced by a process comprising contacting a peripheral sensory neuron with the dsRNA agent of any one of embodi-ments 1-104.

111. A pharmaceutical composition for inhibiting expres-sion of ATXN3, comprising the dsRNA agent of any one of embodiments 1-107.

112. A pharmaceutical composition comprising the dsRNA agent of any one of embodiments 1-107 and a lipid formulation.

113. A method of inhibiting expression of ATXN3 in a cell, the method comprising:

(a) contacting the cell with the dsRNA agent of any one of embodiments 1-107, or a pharmaceutical composition of embodiment 111 or 112; and (b) maintaining the cell produced in step (a) for a time sufficient to obtain degradation of the mRNA transcript of ATXN3 thereby inhibiting expression of ATXN3 in the cell.

114. A method of inhibiting expression of ATXN3 in a cell, the method comprising:

(a) contacting the cell with the dsRNA agent of any one of embodiments 1-107, or a pharmaceutical composition of embodiment 111 or 112; and (b) maintaining the cell produced in step (a) for a time sufficient to reduce levels of ATXN3 mRNA, ATXN3 protein, or both of ATXN3 mRNA and protein, thereby inhibiting expression of ATXN3 in the cell.

115. The method of embodiment 113 or 114, wherein the cell is within a subject.

116. The method of embodiment 115, wherein the subject is a human.

117. The method of any one of embodiments 113-116, wherein the level of ATXN3 mRNA is inhibited by at least 50%.

118. The method of any one of embodiments 113-116, wherein the level of ATXN3 protein is inhibited by at least 50%.

119. The method of embodiment 116-118, wherein inhibiting expression of ATXN3 decreases an ATXN3 protein level in a biological sample (e.g., a cerebral spinal fluid (CSF) sample, or a CNS biopsy sample) from the subject by at least 30%, 40%, 50%, 60%, 70%, 80%, 90%, or 95%.

120. The method of any one of embodiments 116-119, wherein the subject has been diagnosed with an ATXN3-associated disorder, e.g., spinocerebellar ataxia type 3 (SCA3).

121. A method of inhibiting expression of ATXN3 in a cell or tissue, the method comprising:

(a) contacting the cell or tissue with a dsRNA agent that binds ATXN3; and (b) maintaining the cell or tissue produced in step (a) for a time sufficient to reduce levels of ATXN3 mRNA, ATXN3 protein, or both of ATXN3 mRNA and protein, thereby inhibiting expression of ATXN3 in the cell or tissue.

122. The method of embodiment 121, wherein the cell or tissue comprises a neuron, e.g., a motor neuron, e.g., a cerebellum or spinal motor neuron.

123. A method of treating a subject having or diagnosed with having an ATXN3-associated disorder comprising administering to the subject a therapeutically effective amount of the dsRNA agent of any one of embodiments 1-107 or a pharmaceutical composition of embodiment 111 or 112, thereby treating the disorder.

124. The method of embodiment 120 or 123, wherein the ATXN3-associated disorder is spinocerebellar ataxia type 3 (SCA3).

125. The method of embodiment 123 or 124, wherein treating comprises amelioration of at least one sign or symptom of the disorder.

126. The method of embodiment 125, wherein at least one sign or symptom of ATXN3-associated disorder, e.g., SCA3, comprises a measure of one or more ataxia, spasticity, rigidity, bradykinesia, dysarthria, spastic paraplegia, peripheral polyneuropathy, and parkinsonism-like symptoms, level, or activity of ATXN3 (e.g., ATXN3 gene, ATXN3 mRNA, or ATXN3 protein).

127. The method of embodiment 123 or 124, where treating comprises prevention of progression of the disorder.

128. The method of any one of embodiments 123-127, wherein the treating comprises inhibiting or reducing the expression or activity of ATXN3.

129. The method of embodiment 128, wherein the treating results in at least a 30% mean reduction from baseline of ATXN3 mRNA in the cell.

130. The method of embodiment 129, wherein the treating results in at least a 60% mean reduction from baseline of ATXN3 mRNA in the cell.

131. The method of embodiment 130, wherein the treating results in at least a 80% mean reduction from baseline of ATXN3 mRNA in the cell.

132. A method of preventing development of an ATXN3-associated disorder in a subject having a mutation correlated with an ATXN3-associated disorder comprising administering to the subject a therapeutically effective amount of the dsRNA agent of any one of embodiments 1-107, or a pharmaceutical composition of embodiments 111 or 112, thereby preventing the development of an ATXN3-associated disorder in the subject meeting at least one diagnostic criterion for an ATXN3-associated disorder.

133. The method of any of embodiments 115-132, wherein the subject is human.

134. The method of any one of embodiments 116-133, wherein the dsRNA agent is administered at a dose of about 0.01 mg/kg to about 50 mg/kg.

135. The method of any one of embodiments 116-134, wherein the dsRNA agent is administered to the subject intracranially or intrathecally, 136. The method of any one of embodiments 116-134, wherein the dsRNA agent is administered to the subject intrathecally, intraventricularly, or intracerebrally.

137. The method of any one of embodiments 116-139, further comprising measuring level of ATXN3 (e.g., ATXN3 gene, ATXN3 mRNA, or ATXN3 protein) in the subject.

138. The method of embodiment 140, where measuring the level of ATXN3 in the subject comprises measuring the level of ATXN3 gene, ATXN3 protein or ATXN3 mRNA in a biological sample from the subject (e.g., a cerebral spinal fluid (CSF) sample or a CNS biopsy sample).

139. The method of any one of embodiments 116-138, further comprising performing a blood test, an imaging test, a CNS biopsy sample, or an aqueous cerebral spinal biopsy.

140. The method of any one of embodiments 140-139, wherein measuring level of ATXN3 (e.g., ATXN3 gene, ATXN3 mRNA, or ATXN3 protein) in the subject is performed prior to treatment with the dsRNA agent or the pharmaceutical composition.

141. The method of embodiment 140, wherein, upon determination that a subject has a level of ATXN3 (e.g., ATXN3 gene, ATXN3 mRNA, or ATXN3 protein) that is greater than a reference level, the dsRNA agent or the pharmaceutical composition is administered to the subject.

142. The method of any one of embodiments 138-141, wherein measuring level of ATXN3 (e.g., ATXN3 gene, ATXN3 mRNA, or ATXN3 protein) in the subject is performed after treatment with the dsRNA agent or the pharmaceutical composition.

143. The method of any one of embodiments 123-142, further comprising administering to the subject an additional agent and/or therapy suitable for treatment or prevention of an ATXN3-associated disorder.

144. The method of embodiment 143, wherein the additional agent and/or therapy comprises one or more of a symptomatic treatments for Parkinsonism-like symptoms (levodopa or dopamine agonists), psychostimulants to improve daytime fatigue (modafinil), mexiletine or carbamazepine for cramps.

EXAMPLES

Example 1. RNAi Agent Design, Synthesis, Selection, and In Vitro Evaluation

This Example describes methods for the design, synthesis, selection, and in vitro evaluation of ATXN3 RNAi agents.
Source of Reagents Where the source of a reagent is not specifically given herein, such reagent can be obtained from any supplier of reagents for molecular biology at a quality/purity standard for application in molecular biology.
Bioinformatics A set of siRNAs targeting the human ataxin3 gene (ATXN3; human NCBI refseqID NM_001127697.2; NCBI GeneID: 4287) as well the toxicology-species ATXN3 ortholog from cynomolgus monkey: XM_005595835.1 was designed using custom R and Python scripts. All the siRNA designs have a perfect match to the human ATXN3 transcript and a subset either perfect or near-perfect matches to the cynomolgus monkey ortholog. The human NM_001127697 REFSEQ mRNA, version 2, has a length of 6770 bases.

ATXN3 single strands and duplexes were made using routine methods known in the art. A detailed list of the modified ATXN3 sense and antisense strand sequences is shown in Tables 2 and 5 and a detailed list of the unmodified ATXN3 sense and antisense strand sequences is shown in Tables 4A and 4B.

In Vitro Hep3B, be(2)C, and Neuron2A Cell Screening:
Cell Culture and Transfections:

Transfection experiments were performed in human hepatoma Hep3B cells (ATCC HB-8064) with EMEM (ATCC catalog no. 30-2003), human neuroblastoma BE(2)-C cells (ATCC CRL-2268) with EMEM:F12 media (Gibco catalog no. 11765054) and mouse neuroblastoma Neuro2A cells (ATCC CCL-131) with EMEM media. Cells were transfected by adding 4.9 μL of Opti-MEM plus 0.1 μL of RNAiMAX per well (Invitrogen, Carlsbad CA cat #13778-150) to 5 μL of siRNA duplexes per well, with 4 replicates of each siRNA duplex, into a 384-well plate, and incubated at room temperature for 15 minutes. 40 μL of MEDIA containing ~5×103 cells were then added to the siRNA mixture. Cells were incubated for 24 hours prior to RNA purification. Experiments were performed at 10 nM and 0.1 nM.
Total RNA Isolation Using DYNABEADS mRNA Isolation Kit:

RNA was isolated using an automated protocol on a BioTek-EL406 platform using DYNABEADs (Invitrogen, cat #61012). Briefly, 70 μL of Lysis/Binding Buffer and 10 μL of lysis buffer containing 3 μL of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μL Wash Buffer A and once with Wash Buffer B. Beads were then washed with 150 μL Elution Buffer, re-captured and supernatant removed.

cDNA Synthesis Using ABI High Capacity cDNA Reverse Transcription Kit (Applied Biosystems, Foster City, CA, Cat #4368813):

10 μL of a master mix containing 1 μL 10× Buffer, 0.4 μL 25×dNTPs, 1 μL 10× Random primers, 0.5 μL Reverse Transcriptase, 0.5 μL RNase inhibitor and 6.6 μL of $H_2O$ per reaction was added to RNA isolated above. Plates were sealed, mixed, and incubated on an electromagnetic shaker for 10 minutes at room temperature, followed by 2h incubation at 37° C.
Real Time PCR:

2 μL of cDNA were added to a master mix containing 0.5 μL of human or mouse GAPDH TaqMan Probe (ThermoFisher cat 4352934E or 4351309) and 0.5 μL of appropriate ATXN3 probe (Thermo Fisher Taqman human Hs00268077, mouse: Mm00485946) and 5 μL Lightcycler 480 probe master mix (Roche Cat #04887301001) per well in a 384 well plates (Roche cat #04887301001). Real time PCR was done in a LightCycler480 Real Time PCR system (Roche). Each duplex was tested with N=4 and data were normalized to cells transfected with a non-targeting control siRNA. To calculate relative fold change, real time data were analyzed using the ΔΔCt method and normalized to assays performed with cells transfected with a non-targeting control siRNA.
Dual-Glo® Luciferase Assay:

Cos-7 cells (ATCC, Manassas, VA) were grown to near confluence at 37° C. in an atmosphere of 5% $CO_2$ in DMEM (ATCC) supplemented with 10% FBS, before being released from the plate by trypsinization. Multi-dose experiments were performed at 10 nM and 0.1 nM. siRNA and psi-CHECK2-ATXN3 (NM_001127697) plasmid transfections was carried out with a plasmid containing the 3'-untranslated region (UTR). Transfection was carried out by adding 5 μL of siRNA duplexes and 5 μL (5 ng) of psiCHECK2 plasmid per well along with 4.9 μL of Opti-MEM plus 0.1 μL of Lipofectamine 2000 per well (Invitrogen, Carlsbad CA cat #13778-150) and then incubated at room temperature for 15 minutes. The mixture was then added to the cells which were re-suspended in 35 μL of fresh complete media. The transfected cells were incubated at 37° C. in an atmosphere of 5% $CO_2$.

Forty-eight hours after the siRNAs and psiCHECK2 plasmid were transfected; Firefly (transfection control) and Renilla (fused to ATXN3 target sequence) luciferase were measured. First, media was removed from cells. Then Firefly luciferase activity was measured by adding 20 μL of Dual-Glo® Luciferase Reagent equal to the culture medium volume to each well and mix. The mixture was incubated at room temperature for 30 minutes before luminescence (500 nm) was measured on a Spectramax (Molecular Devices) to detect the Firefly luciferase signal. Renilla luciferase activity was measured by adding 20 μL of room temperature of Dual-Glo® Stop & Glo® Reagent was added to each well and the plates were incubated for 10-15 minutes before luminescence was again measured to determine the Renilla luciferase signal. The Dual-Glo® Stop & Glo® Reagent, quenches the firefly luciferase signal and sustained luminescence for the Renilla luciferase reaction. siRNA activity was determined by normalizing the Renilla (ATXN3) signal to the Firefly (control) signal within each well. The magnitude of siRNA activity was then assessed relative to cells that were transfected with the same vector but were not treated with siRNA or were treated with a non-targeting siRNA. All transfections were done with n=4.

TABLE 1

Abbreviations of nucleotide monomers used in nucleic acid sequence
representation. It will be understood that these monomers, when present in an
oligonucleotide, are mutually linked by 5'-3'-phosphodiester bonds.

| Abbreviation | Nucleotide(s) |
|---|---|
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'- phosphorothioate |
| c | 2'-O-methylcytidine-3'-phosphate |
| cs | 2'-O-methylcytidine-3'- phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96[1] | N-[tris(GalNAc-alkyl)-amidodecanoyl)]-4-hydroxyprolinol Hyp-(GalNAc-alkyl)3 (Hyp-(GalNAc-alkyl)3) |
| (Agn) | Adenosine-glycol nucleic acid (GNA) |
| (Cgn) | Cytidine-glycol nucleic acid (GNA) |
| (Ggn) | Guanosine-glycol nucleic acid (GNA) |
| (Tgn) | Thymidine-glycol nucleic acid (GNA) S-Isomer |
| P | Phosphate |
| VP | Vinyl-phosphonate |
| dT | 2'-deoxythymidine-3'-phosphate |
| dTs | 2'-deoxythymidine-3'-phosphorothioate |
| (Ahd) | 2'-O-hexadecyl-adenosine-3'-phosphate |
| (Ahds) | 2'-O-hexadecyl-adenosine-3'-phosphorothioate |
| (Chd) | 2'-O-hexadecyl-cytidine-3'-phosphate |
| (Chds) | 2'-O-hexadecyl-cytidine-3'-phosphorothioate |
| (Ghd) | 2'-O-hexadecyl-guanosine-3'-phosphate |
| (Ghds) | 2'-O-hexadecyl-guanosine-3'-phosphorothioate |
| (Uhd) | 2'-O-hexadecyl-uridine-3'-phosphate |
| (Uhds) | 2'-O-hexadecyl-uridine-3'-phosphorothioate |

[1]The chemical structure of L96 is as follows:

TABLE 2

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-368021 | ususggcuCfcAfGfAfcaaauaaacaL96 | 13 | usGfsuuua(Tgn)uugucugGfgAfgccaascsg | 243 | UUCCACGAGAAACAAGAAGGCUC | 473 |
| AD-368023 | gsgscuccAfgAfCfAfaauaaacauuuL96 | 14 | asAfsuguu(Tgn)auuuguCfuGfgagccsasa | 244 | UUUACAGCAGCCUUCUGGAAAUA | 474 |
| AD-368024 | gscsuccaGfaCfAfAfauaaacaugguL96 | 15 | asCfsaugu(Tgn)uauuugUfcUfggagcscsa | 245 | UACAGCAGCCUUCUGGAAAUAUG | 475 |
| AD-368025 | csusccagAfcAfAfAfAfuaaacauggaL96 | 16 | usCfscaug(Tgn)uuauuuGfuCfuggagcscsc | 246 | ACAGCAGCCUUCUGGAAAUAUGG | 476 |
| AD-368027 | cscsagacAfaAfUfUfAfaacauggaguL96 | 17 | asCfsucca(Tgn)guuuauUfuGfucuggsasg | 247 | UAUUCAGUGGUUUAACUUGGAAUU | 477 |
| AD-368028 | csasgacaAfaUfAfAfAfacauggaguuL96 | 18 | asAfscucc(Agn)uguuuaUfuUfgucugsgsa | 248 | AUUCAGUGGUUUAACUUGGAAUUC | 478 |
| AD-368029 | aggsacaaAfuAfAfAfAfcauggagucuL96 | 19 | asGfsacuc(Cgn)auguuaAfuUfuguucusgsg | 249 | UUCAGUGGUUUAACUUGGAAUUCU | 479 |
| AD-368044 | gsasguccAfuCfUfUfUfcccacgagaaaL96 | 20 | usUfsucuc(Ggn)uggaagAfuGfgacucscsa | 250 | UCAGUGGUUUAACUUGGAAUUCUC | 480 |
| AD-368047 | uscscaucUfuCfCfAfCfcgagaaacaaL96 | 21 | usUfsguuu(Cgn)ucguggAfaGfauggascsu | 251 | ACAGGAAGGUUAUUCUAUAUUUG | 481 |
| AD-368049 | csasucuuCfcAfCfGfagaaacaagaL96 | 22 | usCfsuugu(Tgn)cucguGfgAfagaugsgsa | 252 | GCAUCGACCAAAACUAUUGGAG | 482 |
| AD-368050 | asususcuuCfcAfCfGfAfagaaacaagaaL96 | 23 | usUfscuug(Tgn)uucucgUfgGfaagausgsg | 253 | CAUCGACCAAAACUAUAUUGGAGA | 483 |
| AD-368052 | csusuccaCfgAfGfAfaacaagaaguuL96 | 24 | asCfsuucu(Tgn)guuucuCfgUfggaagsasu | 254 | AUCGACCAAAACUUAUUGGAGAA | 484 |
| AD-368053 | ususccacGfaGfAfAfAfacaagaaggUL96 | 25 | asCfscuuc(Tgn)uguuucUfcGfuggaasgsa | 255 | AGACGAGAGCCUACUUUGAAAA | 485 |
| AD-368055 | cscsacagGfaAfAfCfaagaggcuuL96 | 26 | asAfsgccu(Tgn)cuuguuUfcUfcguggsasa | 256 | GACGAGAGCCUACUUUGAAAAA | 486 |
| AD-368223 | uaascagcAfgCfCfUfUfucuggaaauaL96 | 27 | usAfsuuuc(Cgn)agaaggCfuGfcuguasasa | 257 | CGUUGGCUCCAGACAAAUAAACA | 487 |
| AD-368225 | csasgcagCfcUfUfCffuggaauauauuL96 | 28 | asAfsuauu(Tgn)ccagaaGfgCfugcugsusa | 258 | UUGGCUCCAGACAAAUAAACAUG | 488 |
| AD-368226 | aagscagcCffuUfCfCfUfUfggaaauaugsuL96 | 29 | asCfsaaau(Tgn)uccagaAfgGfcugcusgsu | 259 | UGGCUCCAGACAAAUAAACAUGG | 489 |
| AD-368250 | ususcagugGffuUffUfUfaacugaauuL96 | 30 | asAfsuuca(Agn)guuaacCfcAfcugaasusa | 260 | GGCUCCAGACAAAUAAACAUGGA | 490 |
| AD-368251 | uscsagugGfuUfUfAfacuugaauucuL96 | 31 | asAfsauuc(Agn)aguuaaAfcCfacugasasu | 261 | CUCCAGACAAAUAAACAUGGAGU | 491 |
| AD-368252 | csasgugGfuUfUfAfAfCfuugaauucucL96 | 32 | asGfsaaau(Cgn)aaguuaAfcCfcacugsasa | 262 | UCCAGACAAAUAAACAUGGAGUC | 492 |
| AD-368253 | aggsuggUffuUfAfFfCfuugaauucucuL96 | 33 | asAfsgaau(Tgn)caaguuAfaAfccacusgsa | 263 | CCAGACAAAUAAACAUGGAGUCC | 493 |
| AD-368337 | aggsgaagGffuUfAfUfUfcuauauuugsuL96 | 34 | csAfsaaua(Tgn)agaauaAfcCfuuccusgsu | 264 | UGGAGUCCAUCUCCACGAGAAA | 494 |
| AD-368338 | gsgsgaagGffuFfaUfUfUfcuauauuuguuL96 | 35 | asCfsaaau(Agn)uagaauUfaAfccuucscsug | 265 | AGUCCAUCUCCACGAGAAACAA | 495 |
| AD-368339 | gsasaggUfaUfUfCffuauauuuguuL96 | 36 | asAfscaaa(Tgn)auagaaUfaAfccuucscsu | 266 | UCCAUCUCCACGAGAAACAAGA | 496 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-368427 | asuscgacCfaAfAfAfcuuauuggauL96 | 37 | asUfsccaa(Tgn)aaguuuUfgGfucgausgsc | 267 | CCAUCUUCCACGAGAAACAAGAA | 497 |
| AD-368428 | uscsgaccAfaAfAfAfCfuuauuggagaL96 | 38 | usCfsucca(Agn)uaaguuUfuGfgucgasusg | 268 | AUCUUCCACGAGAAACAAGAAGG | 498 |
| AD-368429 | cgsgaccaAfaAfCfUfuauuggagagaaL96 | 39 | usUfscucc(Agn)auaaguUfuUfggucgsasu | 269 | UCUUCCACGAGAAACAAGAAGGC | 499 |
| AD-368721 | ascsgagaAfgfCfCfUfacuuugaaaaL96 | 40 | usUfsuuca(Agn)aguaggCfuUfcucguscsu | 270 | CAGGAAGGUAAUUCUAUAUUUGU | 500 |
| AD-368722 | cgsagaaGfcCfUfAfcuuugaaaaaL96 | 41 | usUfsuuuc(Agn)aaguagGfcUfucucgususc | 271 | AGGAAGGUAAUUCUAUAUUUGUC | 501 |
| AD-368810 | csusuggGfAfgfUfGfAfucuaggugauL96 | 42 | asUfscacc(Tgn)agaucaCfuUfccaagsusg | 272 | CAAGAAGGUAAUUCUAUAUUUGU | 502 |
| AD-368811 | ususgggacGfuGfAfUfcuaggugauL96 | 43 | asAfsucac(Cgn)uagaucAfcUfcccaasgsu | 273 | AUCCACCAAAACUUAUUGGAGAG | 503 |
| AD-368814 | gsgsagugAfucUfUfAfggugaugcuaL96 | 44 | usAfsgcau(Cgn)accuagAfuCfcacuscscsa | 274 | CUUUUGAAAGAUGGUAAUCUUUU | 504 |
| AD-368815 | gsasgugaUfcUfAfGfgugaugcuauL96 | 45 | asUfsagca(Tgn)caccuaGfaUfcacuscscsc | 275 | GACGAGAAGCCUACUUUGAAAAG | 505 |
| AD-368866 | gsasccauGfucUfUfUfuagaaacuguuL96 | 46 | asCfsagau(Tgn)cuaaaGfcAfugguscsca | 276 | ACCAUGUCUUUAGAAACGUCAG | 506 |
| AD-368867 | ascscauguUfcCfUfUfUfagaaacuguuL96 | 47 | asAfscagu(Tgn)ucuaaaGfaCftaugguscsa | 277 | UUUUGAAAGAUGUGAAUCUUUUC | 507 |
| AD-368868 | cscsauguCfuUfUfAfgaaacugucaL96 | 48 | usGfsacag(Tgn)uucuaaAfgAfcauggsusc | 278 | UUUGAAAGAUGUGAAUCUUUUCU | 508 |
| AD-368869 | csasugucUfuUfUfAfGfaaacugucaL96 | 49 | asUfsgaca(Ggn)uuucuaAfaGfacaugscsau | 279 | UUGAAAGAGAUGUGAAUCUUUUCUG | 509 |
| AD-368871 | usgsucuuUfaGfAfAfacugucagaaL96 | 50 | usUfscuga(Cgn)aguuucUfaAfagacasusg | 280 | UGAAAGAUGUGAAUCUUUUCUGA | 510 |
| AD-368872 | gsuscuuuAfgAfAfAfAfcugucagaaaL96 | 51 | usUfsucug(Agn)caguuuCfuAfaagacsasu | 281 | AUGACUGGUGCGUUCCUAAACUC | 511 |
| AD-368887 | csasgaaaUfgAfUfUfUfugaaaacagaL96 | 52 | usCfsuguu(Tgn)ucaaacUfaUfuucugsasc | 282 | GACUGGUGCGUUCCUAAACUCUG | 512 |
| AD-368891 | asasugauUfuGfAfAfaacagaaggaL96 | 53 | usCfscuuc(Tgn)guuuucAfaAfucauususc | 283 | ACUGGUGCGUUCCUAAACUCUGA | 513 |
| AD-368991 | ususuuagCfgGfUfUfUfugcaacaaaL96 | 54 | usUfsuguu(Tgn)gcaaacCfgCfuaaaasgsu | 284 | UGGUGCGUUCCUAAACUCUGAAA | 514 |
| AD-368992 | ususuuagCfGfgUfUfUfUfugcaacaaaaL96 | 55 | usUfsuugu(Tgn)ugcaaaCfcGfuaaaasasg | 285 | GGUGCGUUCCUAAACUCUGAAAU | 515 |
| AD-368993 | ususagcGfuUfUfUfGfcaaacaaauL96 | 56 | asUfsuuug(Tgn)uugcaaAfcCfgcuaasasa | 286 | UUUUAAAAUGUGUGAGCAUGUG | 516 |
| AD-368994 | usasagcgGfuUfUfGfCfaaacaaauuL96 | 57 | asAfsuuuu(Ggn)uuugcaAfaCfcgcuasasa | 287 | UUUUAAAAUGUGUGAGCAUGUGC | 517 |
| AD-368995 | asgscgguUfuGfCfaAfaacaaauugaL96 | 58 | usCfsauuu(Tgn)guuugcAfaAfccgcusasa | 288 | UGUGUGAGCAUGUGCUUUCCCAG | 518 |
| AD-368996 | gscsgguuUfgCfaAfacaaaugauL96 | 59 | asUfscauu(Tgn)uguuugCfaAfaccgcsusa | 289 | CAUGUCUUUAGAAACUGUCAGAA | 519 |
| AD-368999 | gsusuugcAfaAfCfCfaAfaaaugaugguL96 | 60 | asCfscauc(Agn)uuuuguUfuGfcaaacscsg | 290 | AUGUCUUUAGAAACUGUCAGAAA | 520 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-369000 | ususugcaAafacfAfAfaaugauggGaL96 | 61 | usCfsccau(Cgn)auuuugUfuUfcaaascsc | 291 | GUCAGAAAUGAUUUGAAAACAGA | 521 |
| AD-369082 | gscsauucAafgcCfAfAftuaaagacauuL96 | 62 | asUfsgucu(Tgn)uaauugCfuGfaaugcscsu | 292 | GAAAUGAUUUGAAAACAGAAGGA | 522 |
| AD-369083 | csasuucaGafcAfAfUtuaaagacauuL96 | 63 | asAfsuguc(Tgn)uaaauGfcUfgaaugcscsc | 293 | ACUUUAGCGGUUUGCAAACAAA | 523 |
| AD-369170 | ususugcaGafcAfUfAfgcuaauuaguuL96 | 64 | asCfsuaau(Tgn)agcuagUfcUfgcaaasasa | 294 | GUGUGAGCAUGUGCUUUCCCAGA | 524 |
| AD-369171 | ususugcagAafcUfAfGfcuaauuagcuuL96 | 65 | asGfscuaa(Tgn)uagcuaGfuCfugcaaasasa | 295 | GUGAGCAUGUGCUUUCCCAGAUG | 525 |
| AD-369172 | usgscagaCfuAfGfCfuaauuagcuuL96 | 66 | asAfsgcua(Agn)uuagcuAfgUfcugcasasa | 296 | UGAGCAUGUGCUUUCCCAGAUGC | 526 |
| AD-369173 | gscsagacUfaGfcCfUfaauuagcucuL96 | 67 | asGfeagcu(Agn)auuagcUfaGfucugcsasa | 297 | AGCAUGUGCUUUCCCAGAUGCUU | 527 |
| AD-369174 | csasagacuAfgCfUfAfauuagcucuuL96 | 68 | asAfsgagc(Tgn)aauuagCfuAfgucugcsa | 298 | GCAUGUGCUUUCCCAGAUGCUUU | 528 |
| AD-369314 | gsasuguuGfaUfAfAfUfuaguaaugguuL96 | 69 | asCfscauu(Agn)cuauuaUfcAfacaucsasg | 299 | CUUUAGCGGUUUGCAAACAAAA | 529 |
| AD-369315 | asasguugAfuAfAfUfaguaaugguuL96 | 70 | asAfsccau(Tgn)acuauuAfuCfaacaucsa | 300 | UUUUAGCGGUUUGCAAACAAAU | 530 |
| AD-369316 | usgsuugaUfaAfUfUfaguaaugguuL96 | 71 | asAfsacca(Tgn)uacuauUfaUfcaacasusc | 301 | UUUAGCGGUUUGCAAACAAAUG | 531 |
| AD-369317 | gsususugauaAfaUfAfAfGfuaauugucuuL96 | 72 | asGfsaacc(Agn)uuacuaUfuAfucaacsasu | 302 | UUAGCGGUUUGCAAACAAAUGA | 532 |
| AD-369318 | ususgsauaaAafuAfGfUfUfaauggUuucuaL96 | 73 | usAfsgaac(Cgn)auuacuAfuUfaucaascsa | 303 | UAGCGGUUUGCAAACAAAUGAU | 533 |
| AD-369319 | usgsgsauaaUfaGfUfUfaauggUuucuaL96 | 74 | asUfsagaa(Cgn)cauuacUfaUfuaucasasc | 304 | CGGUUUGCAAACAAAAUGAUGGG | 534 |
| AD-369409 | usususcugCfuAfCfCfUfugguuuucauL96 | 75 | asUfsgaaa(Agn)ccagguAfgCfagaaasasg | 305 | CAUGUGCUUUCCCAGAUGCUUUA | 535 |
| AD-369410 | usususcugCfuAfCfCfUfggguuuucauuL96 | 76 | asAfsugaa(Agn)accaggUfaGfcagaasasa | 306 | GUGCUUUCCCAGAUGCUUUAUGA | 536 |
| AD-369411 | uscscsugcuAfcCfUfUfGfguuuucauuaL96 | 77 | usAfsauga(Agn)aaccagGfuAfgcagasasa | 307 | UGCUUUCCCAGAUGCUUUAUGAA | 537 |
| AD-369414 | gscscsuaccUfgGfUfUfuucauuauuuuL96 | 78 | asAfsauaa(Tgn)gaaaacCfaGfguagcsasg | 308 | GCUUUCCCAGAUGCUUUAUGAAU | 538 |
| AD-369417 | asscscuggUfuUfUfCfAfuuauuuucuL96 | 79 | asGfsaaaa(Tgn)aaugaaAfaCfcaggusasg | 309 | GGUUUGCAAACAAAAUGAUGGGA | 539 |
| AD-369418 | cscscsuggUfuUfUfCfAfuuauuuucucuL96 | 80 | asGfsgaaa(Agn)uaaugaAfaAfccaggsusa | 310 | AGGCAUUCAGCAAUUAAAGACAU | 540 |
| AD-369419 | csususgguUfuUfCfAfUfuauuuucccaL96 | 81 | usGfsggaa(Agn)auaaugAfaAfaccagsgsu | 311 | GGCAUUCAGCAAUUAAAGACAUU | 541 |
| AD-369420 | usgsgguuUfcAfUfUfuauuuucccauuL96 | 82 | asUfsggga(Agn)aauaauGfaAfaaccasgsg | 312 | UUUUUGCAGACUAGCUAAUUAGC | 542 |
| AD-369421 | gsgsuuuucUfaUfUfUfuuucccacacaL96 | 83 | usGfsuggg(Agn)aaauaaUfgAfaaaccsasg | 313 | UUUUGCAGACUAGCUAAUUAGCU | 543 |
| AD-369423 | ususuuucaUfuUfUfUfuucccacacaauL96 | 84 | asUfsugug(Ggn)gaaaauAfaUfgaaaascsc | 314 | UUUGCAGACUAGCUAAUUAGCUC | 544 |
| AD-369424 | usususcauUfaUfUfUfUfuccacaauuL96 | 85 | asAfsuugu(Ggn)ggaaaaUfaAfugaaasasc | 315 | CUUUCCCAGAUGCUUUAUGAAUG | 545 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-369426 | uscsauuaUfuUfUfCfccacaauucuL96 | 86 | asGfsaauu(Ggn)ugggaaAfaUfaaugsasa | 316 | CUUUCACUUAUAUCAAAACCUU | 546 |
| AD-369428 | asusuauuUfuCfCfCfacaauucuuuL96 | 87 | asAfsagaa(Tgn)uguggGfaAfauaausgsa | 317 | UUGCAGACUAGCUAAUUAGCUCU | 547 |
| AD-369429 | ususauuuUfCfCfCfAfcaauucuuuuL96 | 88 | asAfsaaga(Agn)uuguggGfaAfaauaasusg | 318 | UUCACUUAUAUCAAAACCUUACA | 548 |
| AD-369430 | usasuuuuCfcCfAfCfaauucuuuugL96 | 89 | csAfsaaag(Agn)auugugGfgAfaaauasasu | 319 | CACUUAUAUCAAAACCUUACAGC | 549 |
| AD-369431 | asususuuCfcAfCfAfauucuuuugaL96 | 90 | usCfsaaaa(Ggn)aauugugGfgGfaaaausasa | 320 | UGCAGACUAGCUAAUUAGCUCUC | 550 |
| AD-369432 | ususuuccCfaCfAfAfuucuuuugaaL96 | 91 | usUfscaa(Agn)gaauugUfgGfgaaaasusa | 321 | CUGAUGUUGAUAAUAGUAAUGGU | 551 |
| AD-369433 | usususuccCfAfcAfAfUfucuuuugaaaL96 | 92 | usUfsucaa(Agn)agaauuGfuGfggaaasasu | 322 | UGAUGUUGAUAAUAGUAAUGGUU | 552 |
| AD-369434 | ususccccaCfaAfUfUfcuuuugaaaUL96 | 93 | asUfsuuca(Agn)aagaauUfgUfgggaaasa | 323 | GAUGUUGAUAAUAGUAAUGGUUC | 553 |
| AD-369435 | uscscccaCfaAfUfUfCfuuuugaaagaL96 | 94 | usCfsuuuc(Agn)aaagaaUffuGfuguggasasa | 324 | AUGUUGAUAAUAGUAAUGGUUCU | 554 |
| AD-369437 | cscscacaaUfuCfUfUfuugaaagauuL96 | 95 | asAfsucuu(Tgn)caaaagAfaUfuguggsgsa | 325 | UGUUGAUAAUAGUAAUGGUUCUA | 555 |
| AD-369445 | csusuuugAfaAfGfAfUfugguaaucuuL96 | 96 | asAfsgauu(Agn)ccaucuUfuCfuaaaagsasa | 326 | GUUGAUAAUAGUAAUGGUUCUAG | 556 |
| AD-369446 | ususuugaAfaGfEfAfUfgguaaucuuuL96 | 97 | asAfsagau(Tgn)accaucUfuUfcaaaasgsa | 327 | CUUUUCUGCUACCUGGUUUUCAU | 557 |
| AD-369447 | ususugaaAfgAfUfGfguaaucuuuuL96 | 98 | asAfsaaga(Tgn)uaccauCfuUfucaaaasasg | 328 | UUUUCUGCUACCUGGUUUUCAUU | 558 |
| AD-369448 | ususgaaaGfaUfGfGfuaaucuuuucL96 | 99 | gsAfsaaag(Agn)uuaccaUfcUfuucaasasa | 329 | UUUCUGCUACCUGGUUUUCAUUA | 559 |
| AD-369449 | uggsaaaqAfuGfGfGfUfaaucuuuucuuL96 | 100 | asGfsaaaa(Ggn)auuaccCfaUfcuuucsasa | 330 | CUGCUACCUGGUUUUCAUUAUUU | 560 |
| AD-369450 | gsasasagauUfgGfGfUfAfaucuuuucuuL96 | 101 | asAfsgaaa(Agn)gauuacCfaUffcuuucsasa | 331 | CUACCUGGUUUUCAUUAUUUCC | 561 |
| AD-369451 | asasagauGfgUfAfAffucuuuucugaL96 | 102 | usCfsagaa(Agn)agauuaCfcAfucuuuscsa | 332 | UACCUGGUUUUCAUUAUUUCCC | 562 |
| AD-369513 | gsascuggUfgCfGfUfuccuaaacuuL96 | 103 | asAfsguuu(Agn)ggaacgCfaCfcagucsasu | 333 | ACUUAUAUCAAAACCUUACAGCU | 563 |
| AD-369515 | csusggggCfgUfUfCfcuaaacucuuL96 | 104 | asAfsgagu(Tgn)uaggaaCfgCfaccagsusc | 334 | UUAUAUCAAAACCUUACAGCUUU | 564 |
| AD-369516 | uggsgugcGfuUfCfCfuaaacucugaL96 | 105 | usCfsagag(Tgn)uuaggaAfcGfcaccasgsu | 335 | AUAUCAAAACCUUACAGCUUUGU | 565 |
| AD-369517 | gsgsugcgUffuCfCfUfaaacucugaaL96 | 106 | usUfscaga(Ggn)uuuaggAfaCfgcaccsasg | 336 | UAUCAAAACCUUACAGCUUUGUU | 566 |
| AD-369518 | gsusgcguUfcCfUfAfaacucugaaaL96 | 107 | usUfsucag(Agn)guuuagGfaAfcgcacscsa | 337 | AUCAAAACCUUACAGCUUUGUUG | 567 |
| AD-369519 | usgscguuCfcUfAfAfacucugaaauL96 | 108 | asUfsuuca(Ggn)aguuagGfgAfacgcasscsc | 338 | UCAAAACCUUACAGCUUUGUUGC | 568 |
| AD-369559 | ususuaaaAffuGfUfGfugagcauguuL96 | 109 | asAfscaug(Cgn)ucacacAfuUfuuaaasasa | 339 | ACCUGGUUUUCAUUAUUUCCCA | 569 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-369560 | ususaaaaUfgUfGfUfgagcauguguL96 | 110 | asCfsacau(Ggn)cucacacCfaUfuuuaasasa | 340 | CAAAACCUUACAGCUUUGUUGCA | 570 |
| AD-369568 | usgsugagCfaUfGfUfgcuuucccaauL96 | 111 | asUfsggga(Agn)agcacaUfgCfucacascsa | 341 | CCUGGUUUUCAUUAUUUCCCAC | 571 |
| AD-369569 | gousgagcAfuGfUfGfcuuucccagaL96 | 112 | usCfsuggg(Agn)aagcacAfuGfcucacsasc | 342 | AAAACCUUACAGCUUUGUUGCAA | 572 |
| AD-369571 | gsasgcauGfuGfCfUfuucccagauuL96 | 113 | asAfsucug(Ggn)gaaagcAfcAfugcucsasc | 343 | CUGGUUUUCAUUAUUUCCCACA | 573 |
| AD-369572 | aegscaugUfgCfUfUfucccagauguL96 | 114 | asCfsaucu(Ggn)ggaaagcfaCfaugcucsa | 344 | AAACCUUACAGCUUUGUUGCAAC | 574 |
| AD-369574 | csasugugCfuUfUfCfccagagcuuL96 | 115 | asAfsgcau(Cgn)ugggaaAfgCfacaugscsu | 345 | GGUUUUCAUUAUUUCCCACAAU | 575 |
| AD-369575 | asusgugcUfuUfCfCfcagaugcuuuL96 | 116 | asAfsagca(Tgn)cugggaAfaGfcacaugsgsc | 346 | GUUUUCAUUAUUUCCCACAAUU | 576 |
| AD-369576 | usgsugcuUfucCfCfCfagaugcuuuaL96 | 117 | usAfsaagc(Agn)ucugggAfaAfgcacasusg | 347 | AACCUUACAGCUUUGUUGCAACC | 577 |
| AD-369579 | gscsuuucCfcAfGfAftugcuuuaugaL96 | 118 | usCfsauaa(Agn)gcaucuGfgGfaaagcsasc | 348 | UUUCAUUAUUUCCCACAAUUCU | 578 |
| AD-369580 | csusuuccCfaGfAfUfgcuuuaugaaL96 | 119 | usUfscaua(Agn)agcaucUfgGfgaaagcsa | 349 | UCAUUAUUUCCCACAAUUCUUU | 579 |
| AD-369581 | ususucccCfAfgfAfUfGfcuuuaugaauL96 | 120 | asUfsucau(Agn)aagcauCfuGfggaaagsc | 350 | ACCUUACAGCUUUGUUGCAACCC | 580 |
| AD-369582 | ususcccaGfaUfGfCfuuuaugaauuL96 | 121 | asAfsuuca(Tgn)aaagcaUfcUfgggaasasg | 351 | CAUUAUUUCCCACAAUUCUUUU | 581 |
| AD-369606 | ususucaCfUfuAfUfUfAfucaaaaccuuL96 | 122 | asAfsgggu(Tgn)ugauauAfaGfugaaasasg | 352 | CCCUCUCCUGCGCCUUAUUUU | 582 |
| AD-369609 | csascuuaUfUfCfAfaaaccuuacaL96 | 123 | usGfsuaag(Ggn)uuuugaUfaUfaagugsasa | 353 | CCUUCUCCUGCGCCUUAUUUUU | 583 |
| AD-369611 | csusuauaUfcAfAfAfAfccuuacaguL96 | 124 | asCfsugua(Agn)gguuuuGfaUfauaagsusg | 354 | UCCCUUUCUCUCCUCCAAUUGAGAA | 584 |
| AD-369612 | ususauaucfaAfAfAfAfccuuacagcuL96 | 125 | asGfscugu(Agn)agguuuUfgAfuauaasgsu | 355 | UCCUUUCUCUCCUCCAAUUGAGAAA | 585 |
| AD-369614 | asusaucaAfaAfaCfCfuuacagcuuuL96 | 126 | asAfsagcu(Ggn)uaagguUfuUfgauausasa | 356 | CCUUCUCCUCCAAUUGAGAAAAA | 586 |
| AD-369616 | asusucaaAffcCfUfUfacagcuuuguL96 | 127 | asCfsaaag(Cgn)uguaagGfuUfuugausasu | 357 | CUUUCUUCCAAUUGAGAAAAAC | 587 |
| AD-369617 | usscsaaaacfcCfUfUfAfcagcuuuguuL96 | 128 | asAfsfscaa(Cgn)cuguaaGfgUfuuugasusa | 358 | AUUAUUUCCCACAAUUCUUUUG | 588 |
| AD-369618 | csasasaaCffuUfAfCfagcuuuguuaL96 | 129 | asAfssaaca(Agn)gcuguaAfgGfuuuugsasu | 359 | UUAUUUCCCACAAUUCUUUUGA | 589 |
| AD-369619 | asasasaacCfUfaAfCfAfgcuuuguugaL96 | 130 | asCfsaaca(Agn)agcuguAfaGfguuuusgsa | 360 | UAUUUCCCACAAUUCUUUUGAA | 590 |
| AD-369620 | asasaccuUfacfAfGfCfuuuguugcaL96 | 131 | usGfscaac(Agn)aagcugUfaAfgguuususg | 361 | AGCAGUGGGUUAACUUGAAUCU | 591 |
| AD-369621 | asasccuuAfcAfGfCfuuuguugcaaL96 | 132 | usUfsgcaa(Cgn)aaagcuGfuAfagguususu | 362 | AUUUCCCACAAUUCUUUUGAAA | 592 |
| AD-369622 | acscsuuaCfaGfCfUfUfuuguugcaauL96 | 133 | asUfsugca(Agn)caaagcUfgUfaaggsususu | 363 | UUUCCCACAAUUCUUUUGAAAG | 593 |
| AD-369623 | cscsuuacAffgCfUfUfUfuguugcaacuL96 | 134 | asGfsuugc(Agn)acaaagCfuGfuaaggsususu | 364 | UUUCCCACAAUUCUUUUGAAAGA | 594 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-369624 | csusuacaGfcUfUfUfguugcaaccuL96 | 135 | asGfsguug(Cgn)aacaaaGfcUfguaagsgsu | 365 | UCCCACAAUUCUUUGAAGAUG | 595 |
| AD-369625 | csusucuucCfcUfGfCfgccuuauuuuL96 | 136 | asAfsaaua(Agn)ggcgcaGfgAfagaagsgsg | 366 | GCAGUGGUUUAACUUGAAUUCUC | 596 |
| AD-369626 | ususcuucCfuGfCfGfCfccuuauuuuL96 | 137 | asAfsaaau(Agn)aggcgcAfgGfaagaasgsg | 367 | UUCUUUUGAAAGAUGGUAAUCUU | 597 |
| AD-369630 | cscsuuucUfufCfUfCfcaauugagaaL96 | 138 | usUfscuca(Agn)uuggagAfaGfaaaggsasa | 368 | CAAGCAGUGGUUUAACUUGAAUU | 598 |
| AD-369631 | csusuucuUfcUfCfCfcaauugagaaaL96 | 139 | usUfsucuc(Agn)auuggaGfaAfgaaagsgsa | 369 | AAGCAGUGGUUUAACUUGAAUC | 599 |
| AD-369632 | ususucuucCfuCfCfCfAfauuggagaaaaL96 | 140 | usUfsuucu(Cgn)aauuggAfgAfagaaasgsg | 370 | GCAAGAAGGUUAUUCUAUAUUUG | 600 |
| AD-369633 | ususcuucUfcCfAfAfuugagaaaauuL96 | 141 | asUfsuuuc(Tgn)caauugGfaGfaagaasasg | 371 | UCUUUUGAAAGAUGGUAAUCUUU | 601 |
| AD-388251 | csasguggUfuUfAfAfcuugaaucuL96 | 142 | asGfsaauu(Cgn)aaguuaAfaCfcacugscsu | 372 | ACUUGGGAGUGAUCUAGGUGAUG | 602 |
| AD-388252 | aggsugguUfuAfAfCfuugaauucuuL96 | 143 | asAfsgaau(Tgn)caaguuAfaAfccacusgsc | 373 | UGGGAGUGAUCUAGGUGAUGCUA | 603 |
| AD-388257 | aggscaguGfgUfUfUfaacugaauuL96 | 144 | asAfsuuca(Agn)guuaaaCfcAfcugcususg | 374 | CACUGGGAGUGAUCUAGGUGAU | 604 |
| AD-388258 | gscsaguuGfuUfAfacuugaauuuL96 | 145 | asAfsauuc(Agn)aguuaaAfccUfacugcsusu | 375 | CUGGUGCCGUUCCUAAACCUGAA | 605 |
| AD-388330 | asasgaagGfuUfAfUfucuauauuugL96 | 146 | csAfsaaua(Tgn)agaauaAfcCfuucuusgsc | 376 | GGGAGUGAUCUAGGUGAUGCUAU | 606 |
| AD-388331 | aggsaaggUfuAfUfUfcuauauuuguL96 | 147 | asCfsaaau(Agn)uagaauAfaCfcuucususg | 377 | GUGACCAUGUCUUUAGAAACUGU | 607 |
| AD-388403 | csgsaccaAfaAfCfUfuauuggagauL96 | 148 | asUfscucc(Agn)auaaguUfuUfggucgsasu | 378 | UGACCAUGUCUUUAGAAACUGUC | 608 |
| AD-388693 | csgsagaaGfcCfUfUfAfcuuugaaaauL96 | 149 | asUfsuuuc(Agn)aaguagGfcUfucucgsusc | 379 | GACCAUGUCUUUAGAAACUGUCA | 609 |
| AD-413817 | gsasguccAfuCfUfUfUfccacgagaaaL96 | 150 | VPusUfsucuCfgUfGfgaagAfuGfgacucscsa | 380 | CACUGGACUAAUAGGAAUAACUU | 610 |
| AD-413834 | gsgsccuccAfgCfCfAfAfaauaaacauaL96 | 151 | VPusAfsuguUfuAfUfuuguCfuGfgagccsasa | 381 | UAGUCCUAACAAGUGUAGAGCUA | 611 |
| AD-413843 | asasuaacCfaUfCfGfGfaguccaucuaL96 | 152 | VPusAfsgauGfgAfCfuccaUfgUfuuauuusug | 382 | UUAGUCCUAACAAGUGUAGAGCU | 612 |
| AD-413849 | aggsuccaUfuCfCfUfCfcacgagaaaL96 | 153 | VPusUfsuucUfcGfUfggaaGfaUfggacuscsc | 383 | ACUGGACUAAUAGGAAUAACUUU | 613 |
| AD-413912 | uggscaagGfaGfAfGfuauuuuagcaL96 | 154 | VPusGfscuaAfaAfUfacucUfcCfuugcasasu | 384 | AGUGAAGACUACCCGACCAUUUUU | 614 |
| AD-413913 | gscsaaggAfgAfGfGfUfauuuuagccaL96 | 155 | VPusGfsgcuAfaAfAfuacuCfuCfcuugcsasa | 385 | UGAAGACUACCGCACCAUUUUAC | 615 |
| AD-413959 | gsasagacUfaCfCfCfGfcacuuuuuaL96 | 156 | VPusAfsaaaAfuGfUfgcggUfaGfucuucsasc | 386 | CGAAAGAUCCUUUAUAUGCAAUU | 616 |
| AD-413960 | aggsacuaCfcGfCfCfAfcauuuuuacaL96 | 157 | VPusGfsuaaAfaAfAfgucGfgUfagucususc | 387 | AUAAAGAACACUGGUUUACAGUU | 617 |
| AD-413961 | csusaccgCfaCfAfUfuuuuacagcaL96 | 158 | VPusGfscugUfaAfAfaaugUfgCfgguagsusc | 388 | CAAGCAGUGGUUUAACUUGAAUU | 618 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-413986 | gsusgaagAfcUfAfCfccgcacauuuaL96 | 159 | VPusAfsaauGfuGfCfgguaGfuCfuucacsusa | 389 | AGACACUGGUUUACAGUUAGAA | 619 |
| AD-413987 | usggaagaCfuAfCfCfgcacauuuuaL96 | 160 | VPusAfsaaaUfgUfGfcgguAfgUfcuucascsu | 390 | GAACACUGGUUUACAGUUAGAAA | 620 |
| AD-413988 | asasgacuAfcCfGfCfacauuuuuaL96 | 161 | VPusUfsaaaAfaUfGfugcgGfuAfgcuuscsca | 391 | UGCAAUUAUAAAGAACACUGGUU | 621 |
| AD-413990 | accsuaccGfcAfCfAfuuuuacagaL96 | 162 | VPusCfsuguAfaAfAfauguGfcGfguaguscsu | 392 | AAAGAACACUGGUUUACAGUUAG | 622 |
| AD-413991 | uascecgcAfcAfUfUfuuuacagcaaL96 | 163 | VPusUfsgcugCfuAfAfaaauGfuGfcgguasgsu | 393 | AUUACAGCAAGAAGGUUAUUCUA | 623 |
| AD-413993 | cscsgcacAfuUfUfUfUfuacagcagcaL96 | 164 | VPusGfscugCfuGfUfaaaaAfuGfugcggsusa | 394 | UCAUUACAGCAAGAAGGUUAUU | 624 |
| AD-414002 | csasgcagCfcUfUfCfuggaauauaaL96 | 165 | VPusAfsuauUfuCfCfagaaGfgCfugcugsusa | 395 | CAAUUACAGCAAGAAGGUUAUUC | 625 |
| AD-414020 | csasgcggCfuUfUfUfucucuauucaL96 | 166 | VPusGfsaauAfgAfGfaaaaAfgCfccgcugsusc | 396 | CAGCAAGAGGUUAUUCUAUAUU | 626 |
| AD-414025 | uscsucuaUfucAfAffguuauaaagcaL96 | 167 | VPusGfscuuAfuAfUfcuugAfaUfagagasasa | 397 | UUAAGGGUGAUCUGCCAGAUUGU | 627 |
| AD-414026 | csuscuauUfcAfAfGfuuauaaagcaaL96 | 168 | VPusUfsgcuUfaUfAfacuuGfaAfuagagsasa | 398 | GAUUGUGAAGCUGACCAACUUUU | 628 |
| AD-414044 | usgsacagCfgGfCfUfuuuucucuaaL96 | 169 | VPusUfsagaGfaAfAfaagcCfgCfugucasusc | 399 | ACAGCCAAGAAGGUUAUUCUAUAU | 629 |
| AD-414047 | gscsggcuUfuUfUfUfCfucuauucaaaL96 | 170 | VPusUfsugaAfuAfUfGfagaaAfaAfgccgcsusg | 400 | AGCAAGAAGGUUAUUCUAUAUUU | 630 |
| AD-414055 | usasuucaAfgUfUfAfuaagcaaugaL96 | 171 | VPusCfsauuGfcUfUfauaaCftUfgaauasgsa | 401 | AUGUGAAGCUGACCAACUUUUG | 631 |
| AD-414104 | asasgaucCfuUfUfAfuaugcaauuaL96 | 172 | VPusAfsauuGfcAfUfauaaaAfgGfaucusususc | 402 | CAACAGAUGCAUCGACCAAAACU | 632 |
| AD-414112 | asascacuGfgUfUfUfUfacaguuagaaL96 | 173 | VPusUfscuaAfcUfGfuaaaCffcAfguguuscsu | 403 | GCAUCGACCAAAACUUAUUGGAG | 633 |
| AD-414113 | acssacugGfuUfUfAfAfcaguuagaaaL96 | 174 | VPusUfsucuAfacUfUfguaaAfcCfaguguususc | 404 | CAGUAUGCAAGGUAGUUCCAGAA | 634 |
| AD-414139 | asasagauCfcUfUfUfUfauaugcaauaL96 | 175 | VPusAfsuugCftaUfAfuaaaGfgAfucuuuscsg | 405 | AGAUGAUCAAGGUCCAACAGAUG | 635 |
| AD-414146 | csasauuaUfaAfAfGfaacacuggualL96 | 176 | VPusAfsccaGfuGfUfucuuUfaUfaauugscsa | 406 | AACAGAUGCAUCGACCAAAACUU | 636 |
| AD-414151 | asasagaaCfacUfGfGfguuuacaguaL96 | 177 | VPusAfscugUfaAfAfcagUfgUfucuuusasu | 407 | CAGAUGCAUCGACCAAAACUUAU | 637 |
| AD-414152 | agsgaacaCfuGfGfUfuuacaguuaaL96 | 178 | VPusUfsaacUfgUfAfaacAfgUfuucucsususu | 408 | AGAUGCAUCGACCAAAACUUAUU | 638 |
| AD-414171 | asggcaguGfgUfUfUfaacuugaauaL96 | 179 | VPusUfsuucAfcAfGfUfuaaaCffcAfcugcususg | 409 | GCCUACUUUGAAAAGCAACAGCA | 639 |
| AD-414245 | usasscagCfaAfaGfAfAfAfgguuauucuaL96 | 180 | VPusAfsguuCfuUfUfUfcuucUfuGfcugusasasu | 410 | UAGCUCUUGCCUCCAGAGAACUUGAU | 640 |
| AD-414262 | asasuuacAfgCfAfFfAfgaaggu uauaL96 | 181 | VPusAfsuaaCfcUfUfcuugCffuGfuaausgsa | 411 | GCAAUAUCUGACUGAAAAUUAUGG | 641 |
| AD-414263 | asusuacaGfcAfFfAfFfGfaagguuaauaL96 | 182 | VPusAfsauaAfcCfUffucuuGfcUfguaaususg | 412 | UUAGCUCUUGCCUCCAGAGAACUUGA | 642 |
| AD-414265 | ascsagcaAfgAfAfFfGfguuauucuaaL96 | 183 | VPusUfsagaAfuAfAfcuuCffuUfgcgusasa | 413 | UUCUUAGAGAAAAUAGGCUGCUA | 643 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-414266 | aggscaagAfaGfGfUftauucuauaaL96 | 184 | VPusUfsauaGfaAfUfaaccUfuCfuugcusgsu | 414 | UAGAAAAUAGGCUGCUAGGAUGA | 644 |
| AD-414267 | gscsaagaAfgGfUfUfauucuauauaL96 | 185 | VPusAfsuauAfgAfAfuaacCfuUfcuugcsusg | 415 | UCUAGUAGAAAAUAGGCUGCUAG | 645 |
| AD-414268 | csasagaaGfgGfUfUfAftuucuauauauaL96 | 186 | VPusAfsauaUfaGfAfauaaCfcUfucuugcscsu | 416 | GUAGAAAAUAGGCUGCUAGGAUG | 646 |
| AD-414288 | asasgggUfaUfCfUfGfgccagauugaL96 | 187 | VPusCfsaauCfuGfGfcagaUfcAfcccuusasa | 417 | UGGUAUGAUUUGGGUGGAAAUUA | 647 |
| AD-414300 | ususgugaAfgCfUfGfGfaccacuuuuaL96 | 188 | VPusAfsaagUfuGfGfucagCfuUfcacaasusc | 418 | GUGGUAUGAUUUGGGUGGAAAUU | 648 |
| AD-414301 | usgsugaaGfcUfGfCfAfccaacuuuuaL96 | 189 | VPusAfsaaaGfuUfGfgucaGfcUfucacasasu | 419 | UCUGCACACGUUUUUAUCAGGGA | 649 |
| AD-414319 | csasacagAfuGfCfAftucgaccaaaaL96 | 190 | VPusUfsuugGfuCfGfaugcAfuCfguguugsgsa | 420 | UUUGGAUGUAGGAUUUAUUGCUG | 650 |
| AD-414320 | asgsgaugCfaFfuCfGfAfCfcaaaacuuaL96 | 191 | VPusAfsaguUfuUfGfgucgAfuGfcaucusgsu | 421 | CAGUAUGAAAAGAUGCCAAUGCU | 651 |
| AD-414322 | uscsgaccAfaAfAfCftuuauuggagaL96 | 192 | VPusCfsuccAfaFfAfaguuUfuGfgucgasusg | 422 | UAAUUUAGUCCUAACAAGUGUAG | 652 |
| AD-414343 | csasgaugAfucCfAfAfAfgguccaacaaL96 | 193 | VPusUfsguuGfaAfCfcuugAfuCfaucugscsa | 423 | CUGCACACGUUUUUAUCAGGGAA | 653 |
| AD-414344 | gsasugauCfaAfGfGfuccaacagaaL96 | 194 | VPusUfscugUfuGfGfaccUfgAfucaucsusg | 424 | UGCACACGUUUUUAUCAGGGAAA | 654 |
| AD-414345 | asusgaucAfaGfGfUfCftgaccaacaaaL96 | 195 | VPusAfsucuGfuUfGfgaccUfuGfEaucauscsu | 425 | CGUUUUUAUCAGGGAAAGUUUG | 655 |
| AD-414353 | aescsagauGfcAfUfUfCftgaccaaaacaaL96 | 196 | VPusGfsuuuUfgGfUfcgauGfcAfucugususg | 426 | UCAGUAAUUGCAAAGGUUCAGAA | 656 |
| AD-414354 | csasgaugCfaUfCfGfCftgaccaaaacuaL96 | 197 | VPusAfsfgguUfuUfGfGfcAfucgauUfgCfaucugsusu | 427 | GUAUGAAAAGAUGCCAAUGCUUA | 657 |
| AD-414355 | gsasugcaUfcGfAfCfCftcaaaacuuaaL96 | 198 | VPusUfsaagUfuUfUfgguCfGfaUfugcaucsusg | 428 | UAGCCACAGUAUCCAAAGUGUAG | 658 |
| AD-414356 | asusgcauCfgAfCfCfCftaaaacuuauaaL96 | 199 | VPusAfsuaaGfuUfUfugguCfgAfugcauscsu | 429 | UUUUUCUUGAUGGAGCCAAAGUU | 659 |
| AD-414359 | asuscsgacCfaAfAfAfCfAfcuuauuggaaL96 | 200 | VPusUfsccaAffUfaAfAfguuuUfgGfucgausgsc | 430 | UGAUGAAGCCAAAGUUAUGAGAGC | 660 |
| AD-414534 | gsusaugcAfaGffGfUfAfaguuccagaaL96 | 201 | VPusUfscugGfaAfCfuaccUfuGfcaucacsusg | 431 | ACACUGGACUAAUAGGAAUAAACU | 661 |
| AD-414563 | uscsagcuCfaGfUfUfAfugcaagguaaL96 | 202 | VPusUfsaccUfuGfCfauacUfgAfgcugasasu | 432 | CUGUCAUUUUAAGGAAUUAGCACA | 662 |
| AD-414564 | csasgcucAffgUfAfUfUfgcaagguagaL96 | 203 | VPusCfsuaaCffuUffUfGfcauaCfuUfEagcugsasa | 433 | ACAACACUGGACUAAUAGGAAUA | 663 |
| AD-414566 | gscsucagUfaUffGfCfaagguaguuaL96 | 204 | VPusAfsacuAfcCfIfUfugcaUfaCftugagcsusg | 434 | UACAACACUGGACUAAUAGGAAU | 664 |
| AD-414619 | csusasacuuUfgAfAfAfAfagcaacagcaL96 | 205 | VPusGfscugUfuGfCfuuuuCfaAfaguagsgsc | 435 | UGGACUAAUAGGAAUAAACUUUUU | 665 |
| AD-414943 | asgsguguUffugUffUfAfagcagaaagaL96 | 206 | VPusCfsuuuCffuGfIfCftuuacAfaAfEccacusasc | 436 | UGGAGUCCAUCUUCCACGAGAAA | 666 |
| AD-414983 | asasgaggCfaGfUfCfagcaaugaaaL96 | 207 | VPusUfsucaUfuGfCftugacUfgCfcucuususg | 437 | UUGGCUCCAGACAAUAAACAUG | 667 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-414996 | asasaugUGfcAfAfAfUfaucugacugaL96 | 208 | VPusCfsaguCfaGfAfuauuGfcAfcauuusgsa | 438 | AUUGCAAGGAGAGAGUAUUUUAGCC | 668 |
| AD-414997 | asasugugCfaAfUfAfucugacugaaL96 | 209 | VPusUfscagUfcAfGfauauUfgCfacauususg | 439 | UUGCAAGGAGAGUAUUUUAGCCC | 669 |
| AD-415000 | asusaucuGfacUfUfGfaaauuauggaL96 | 210 | VPusCfscauAfaUfUfucaguUfcAfgauaususg | 440 | GAAGACUACCGCACAUUUUACA | 670 |
| AD-415038 | ususcaaaUfgUfGfGfCfaauaucugaaL96 | 211 | VPusUfscagAfuAfUfugcaCfaUfuugaasasa | 441 | CAAAUAAACAUGGAGUCCAUCUU | 671 |
| AD-415039 | uscsaaauGfugFfCfAfauaucugacaL96 | 212 | VPusGfsucaGfaUfAfuugcAfcAfuuugasasa | 442 | GGAGUCCAUCUUCCACGAGAAAC | 672 |
| AD-415045 | asasuaucUfgAfCfUfUfgaaauuaugaL96 | 213 | VPusCfsauaAfuUfUfcaguCfaGfauauusgsc | 443 | GUGAAGACUACCGCACAUUUUUA | 673 |
| AD-415060 | aggscucuUfgCfCfAfcagaacugaL96 | 214 | VPusCfsaagUfuCfUfguggCfaAfgagcusasa | 444 | GACUACCGCACAUUUUUACAGCA | 674 |
| AD-415095 | gscsucuuGfccCfAfCfagaacugaaL96 | 215 | VPusUfscaaGfuUfCfugugGfCfAfagagcsusa | 445 | UAGUGAAGACUACCGCACAUUUU | 675 |
| AD-415621 | csusaguaGfaAfAfAfuaggcugcuaL96 | 216 | VPusAfsgcaGfcCfUfauuuUfcUfacuagsasa | 446 | AGACUACCGCACAUUUUACAGC | 676 |
| AD-415623 | gsasaaauAfgGfCfUfUfgcuaggaugauL96 | 217 | VPusCfsaucCfuAfGfcagcCfuAfuuuucsusa | 447 | UACAGCAGCCUUCUGGAAAUAUG | 677 |
| AD-415647 | usasguagAfaAfAfUfaggcugcuaaL96 | 218 | VPusUfsagcAfgcCfCfuauuUfucUfuacuasgsa | 448 | ACUACCGCACAUUUUACAGCAG | 678 |
| AD-415650 | aggsaaaaUfagGfGfCfugcuaggauaL96 | 219 | VPusAfsuccUfaGfCfagccUfaUfuuucusasc | 449 | UACCGCACAUUUUACAGCAGCC | 679 |
| AD-415783 | gsusaugaUfuUfGfGfGfgggaaauuaL96 | 220 | VPusAfsauuUfccCfAfcccaAfaUfcauacscsa | 450 | UUUCUCUAUUCAAGUAUAUAAGCA | 680 |
| AD-415823 | gsggsuaugAfuUfUfGfggugggaaauaL96 | 221 | VPusAfsuuuCfcAfCfccaaAfuCfauaccssasc | 451 | GACAGCGGCUUUUUCUCUAUUCA | 681 |
| AD-415913 | usgscacaCfgUfUfUfuauucagggaL96 | 222 | VPusCfsccugCfaUfAfaaaaCfgUfgugcasgsa | 452 | UUCUCUAUUCAAGUAUAUAAGCAA | 682 |
| AD-415914 | gscsacacGfuUfUfUfUfuaucagggaaL96 | 223 | VPusUfscccCfugGfAfUfaaaaAfcGfgugugcsasg | 453 | GAUGACAGCGGCUUUUUCUCUAU | 683 |
| AD-415915 | csascacgUfuUfUfUfUfaucagggaaaL96 | 224 | VPusUfsucccCfuuGfAfuaaaAfaCfgugugscsa | 454 | CAGCGGCUUUUUCUCUAUUCAAG | 684 |
| AD-415962 | ususuuuaUfcAfCfGfGfgaaaguuuuaL96 | 225 | VPusAfsaaaCfuUfccccGfaUfaaaascsg | 455 | UCUAUUCAAGUUAUAAGCAAUGC | 685 |
| AD-415996 | usgsggaugUfaGfCfAfuucaugcuaL96 | 226 | VPusAfsgcaAfuAfAfauccUfaCffauccasasa | 456 | GAAAGAUCCUUUAUAUGCAAUUA | 686 |
| AD-416175 | asgsgaauAfgAfUfGfccaaugcuaL96 | 227 | VPusUfscugAfacCfuuugCfaAfuuacusgsa | 457 | UUACAGCAAGAAGGUUAUUCUAU | 687 |
| AD-416604 | asusagaaAfgGfUfUfGfcaaugcuuaL96 | 228 | VPusAfsagcAfuUfGfgcaucUfuUfuucausasc | 458 | ACAGAUGCAUCGACCAAAACUUA | 688 |
| AD-416632 | gsusaugaAfaAfGfAfAfugccaaugcaL96 | 229 | VPusGfscauUfgGfCfaucuUfuUfcauacsusg | 459 | UCCAACAGAUGCAUCGACCAAAA | 689 |
| AD-416651 | gscsscacaGfuAfUfCfcaaaguaaL96 | 230 | VPusUfsacaCfuUfGfgauAfucUfgugggcsusa | 460 | CAUCGACCAAAACUUAUUGGGAGA | 690 |
| AD-417251 | ususuucuuGfaUfUfGfaagccaaaguaL96 | 231 | VPusAfscuuUfgGfCfuuucaUfcAfagaaasasa | 461 | UGCAGAUGAUCAAGGUCCAACAG | 691 |
| AD-417255 | asusgaagCfcAfAfAfAfguuaauagagaL96 | 232 | VPusCfsuucAfuAfCfcuuuGfcfuucausscsa | 462 | CAGAUGAUCAAGGUCCAACAGAU | 692 |

TABLE 2-continued

ATXN3 Modified Sequences

| Duplex Name | Modified sense strand sequence | SEQ ID NO | Modified antisense strand sequence | SEQ ID NO | mRNA target sequence | SEQ ID NO |
|---|---|---|---|---|---|---|
| AD-417711 | asusuuagUfcCfUfAfacaaguguaaL96 | 233 | VPusUfsacaCfuUfGfuuagGfaCfuaaaususa | 463 | AUUCAGCUCAGUAUGCAAGGUAG | 693 |
| AD-417714 | gsusccuaAfcAfcAfAfGfuguagagcuaL96 | 234 | VPusAfsgcuCfuAfCfacuuGfuUfaggacsusa | 464 | CAGCUCAGUAUGCAAGGUAGUUC | 694 |
| AD-417736 | aggsuccuAfacCfAfAfAfguguagagcaL96 | 235 | VPusGfscucUfaCfAfcuugUffuAfggacusasa | 465 | UUCAGCUCAGUAUGCAAGGUAGU | 695 |
| AD-417864 | gsuscauuUfuAfAfAfGfaauuagcacaL96 | 236 | VPusGfsugcUfaAfUfucuuAfaAfaugacsasg | 466 | GUAGUGGUUUGUAAGCAGAAAGG | 696 |
| AD-418067 | asascacuGfgAfCfUfaauaggaauaL96 | 237 | VPusAfsuucCfuAfUfuaguCffcAfgugusgsu | 467 | UCAAAUGUGCAAUAUCUGACUGA | 697 |
| AD-418094 | csasacacUfgGfAfCfuaauaggaaaL96 | 238 | VPusUfsuccUfaUfUfagucCfaGfuguugsusa | 468 | CAAAGAGGCAGUCAGCCAAUGAAA | 698 |
| AD-418096 | ascssuggaCfuAfUfAfUfaggaauaaacuaL96 | 239 | VPusGfsuuaUfuCfCfuauuAfgUfccagusgsu | 469 | CAAAUGUGCAAUAUCUGACUGAA | 699 |
| AD-418097 | csusggacUfaAfUfUfAfUfggaauaaacuaL96 | 240 | VPusAfsguuAfuUfCfcuauUfaGfuccagsusg | 470 | CAAUAUCUGACUGAAAUUAUGGA | 700 |
| AD-418098 | usgsgacuUfafUfAfUfAfgggaauaacuuuaL96 | 241 | VPusAfsaguUfaUfUfccuaUfuAfguccasgsu | 471 | UUUUCAAAUGUGCAAUAUCUGAC | 701 |
| AD-418100 | gsascuaaUfaGfGfAfauaacuuuuuaL96 | 242 | VPusAfsaaaGfuUfAfuuccUfaUfuaguscscsa | 472 | UUUCAAAUGUGCAAUAUCUGACU | 702 |

TABLE 3

ATXN 3 data_in vitro screen in Cos-7 (Human Dual-Luciferase psiCHECK2 vector) and Endogenous Cell Systems using the Duplexes of Table 2

| Duplex Name | Neuro 2A 10 nM | SD | Neuro 2A 0.1 nM | SD | Hep3b 10 nM | SD | Hep3b 0.1 nM | SD | Be(2)C 10 nM | SD | Be(2)C 0.1 nM | SD | DL UTR 10 nM | SD | DL UTR 0.1 nM | SD |
|---|---|---|---|---|---|---|---|---|---|---|---|---|---|---|---|---|
| AD-414943 | 9.0 | 2.2 | 41.8 | 6.1 | 177.8 | 60.5 | 66.8 | 20.5 | 120.6 | 6.0 | 114.2 | 11.8 | 101.5 | 42.4 | 72.8 | 12.9 |
| AD-414983 | 15.2 | 2.7 | 53.7 | 5.6 | 141.9 | 35.4 | 69.5 | 20.4 | 77.0 | 24.6 | 102.7 | 23.4 | 36.5 | 1.0 | 71.8 | 53.0 |
| AD-415038 | 20.8 | 5.9 | 100.7 | 13.8 | 112.9 | 74.1 | 105.1 | 37.2 | 130.9 | 13.5 | 120.9 | 31.0 | 127.5 | 39.3 | 99.1 | 5.4 |
| AD-415039 | 6.2 | 2.8 | 44.5 | 13.5 | 92.0 | 30.1 | 65.2 | 18.9 | 140.7 | 16.0 | 124.5 | 39.3 | 85.9 | 34.3 | 56.5 | 28.0 |
| AD-414996 | 8.2 | 1.3 | 62.2 | 22.0 | 76.5 | 21.5 | 190.1 | 20.4 | 145.0 | 14.2 | 110.4 | 15.3 | 105.0 | 48.5 | 92.6 | 23.2 |
| AD-414997 | 6.4 | 1.2 | 47.3 | 17.3 | 242.5 | 158.1 | 121.3 | 84.6 | 113.4 | 25.1 | 128.4 | 21.1 | 62.0 | 29.8 | 103.7 | 14.3 |
| AD-415045 | 2.6 | 0.9 | 26.5 | 13.4 | 90.0 | 24.4 | 89.8 | 27.7 | 137.5 | 5.6 | 87.6 | 13.2 | 94.1 | 7.8 | 95.7 | 18.7 |
| AD-415000 | 6.1 | 0.6 | 43.4 | 2.4 | 100.9 | 37.4 | 162.4 | 27.5 | 136.3 | 17.4 | 111.1 | 7.6 | 117.2 | 33.4 | 126.1 | 27.3 |
| AD-415060 | 3.9 | 0.8 | 50.4 | 12.2 | 46.9 | 3.4 | 191.6 | 24.3 | 108.3 | 43.5 | 106.7 | 38.0 | 107.1 | 40.7 | 121.6 | 10.7 |
| AD-415095 | 8.4 | 0.9 | 63.3 | 11.0 | 77.2 | 43.5 | 90.5 | 29.8 | 118.9 | 18.7 | 159.7 | 44.0 | 117.0 | 37.6 | 112.0 | 4.4 |
| AD-413912 | 5.9 | 2.9 | 74.0 | 20.3 | 143.8 | 166.0 | 111.7 | 65.2 | 59.4 | 1.5 | 105.7 | 23.1 | 127.5 | 23.8 | 101.6 | 25.8 |
| AD-413913 | 14.2 | 2.4 | 107.2 | 20.0 | 160.1 | 116.4 | 84.4 | 32.9 | 96.5 | 29.2 | 130.5 | 25.4 | 79.6 | 5.8 | 94.3 | 25.3 |
| AD-415621 | 14.9 | 6.3 | 39.1 | 10.1 | 81.3 | 28.5 | 95.2 | 41.9 | 118.1 | 24.3 | 102.7 | 20.5 | 43.3 | 5.7 | 93.9 | 50.5 |
| AD-415647 | 18.2 | 4.5 | 76.5 | 21.3 | 83.0 | 18.6 | 100.0 | 28.3 | 140.0 | 34.9 | 102.8 | 14.2 | 58.9 | 15.4 | 109.0 | 39.8 |
| AD-415650 | 14.4 | 4.1 | 37.8 | 9.5 | 57.2 | 15.8 | 95.2 | 38.2 | 93.7 | 6.7 | 104.5 | 5.4 | 68.6 | 54.9 | 42.5 | 12.4 |
| AD-415623 | 15.1 | 2.6 | 81.0 | 19.3 | 66.3 | 12.4 | 70.4 | 20.9 | 108.7 | 16.4 | 121.7 | 16.0 | 41.6 | 9.9 | 161.4 | 85.4 |
| AD-415823 | 22.8 | 4.9 | 60.1 | 15.8 | 79.4 | 43.6 | 84.6 | 7.3 | 115.3 | 24.5 | 115.5 | 18.6 | 71.8 | 58.3 | 93.3 | 9.6 |
| AD-415783 | 17.5 | 3.3 | 64.2 | 13.2 | 55.2 | 4.6 | 100.8 | 9.0 | 163.5 | 17.9 | 113.7 | 13.7 | 58.9 | 17.9 | 80.6 | 39.7 |
| AD-415913 | 24.4 | 5.9 | 121.6 | 21.2 | 167.0 | 58.6 | 77.4 | 44.2 | 89.0 | 15.0 | 119.0 | 26.1 | 45.9 | 11.6 | 69.6 | 25.8 |
| AD-415914 | 24.3 | 4.9 | 81.6 | 14.9 | 68.0 | 40.2 | 74.3 | 27.9 | 99.8 | 23.7 | 134.1 | 12.4 | 62.5 | 16.5 | 58.3 | 26.1 |
| AD-415915 | 27.1 | 7.8 | 63.0 | 14.6 | 36.4 | 22.6 | 68.2 | 3.3 | 109.5 | 8.9 | 107.9 | 34.6 | 68.0 | 24.8 | 75.9 | 38.5 |
| AD-415962 | 26.5 | 3.9 | 85.8 | 26.3 | 154.5 | 47.2 | 66.8 | 32.2 | 75.7 | 14.2 | 108.3 | 25.5 | 89.3 | 32.5 | 71.5 | 25.4 |
| AD-415996 | 12.0 | 1.3 | 53.3 | 6.0 | 111.8 | 77.4 | 70.8 | 13.1 | 93.7 | 18.0 | 116.2 | 41.0 | 84.4 | 16.7 | 86.9 | 45.7 |
| AD-413986 | 15.8 | 1.8 | 79.9 | 20.2 | 63.7 | 24.3 | 68.3 | 18.2 | 88.7 | 14.6 | 92.6 | 11.2 | 46.9 | 21.3 | 68.7 | 29.9 |
| AD-413987 | 17.0 | 5.6 | 103.8 | 19.3 | 87.7 | 34.5 | 69.6 | 54.4 | 104.6 | 18.7 | 92.2 | 18.9 | 78.0 | 34.7 | 52.4 | 25.3 |
| AD-413959 | 11.4 | 4.5 | 56.0 | 16.6 | 62.5 | 22.0 | 66.5 | 3.4 | 114.4 | 12.3 | 119.1 | 17.2 | 110.6 | 22.7 | 134.5 | 71.4 |
| AD-413988 | 12.5 | 2.9 | 82.4 | 23.1 | 86.4 | 24.7 | 82.5 | 14.8 | 66.2 | 12.7 | 100.5 | 25.1 | 65.5 | 24.3 | 68.5 | 31.2 |
| AD-413960 | 14.6 | 1.7 | 92.0 | 19.0 | 60.0 | 7.8 | 103.4 | 31.4 | 112.2 | 17.7 | 98.4 | 18.8 | 73.4 | 9.9 | 67.6 | 8.1 |
| AD-413990 | 12.1 | 2.7 | 112.3 | 21.0 | 73.0 | 15.2 | 52.7 | 16.3 | 97.2 | 6.8 | 100.7 | 30.8 | 68.5 | 9.8 | 69.2 | 27.5 |
| AD-413961 | 13.6 | 3.2 | 82.5 | 18.7 | 71.5 | 13.2 | 66.2 | 25.9 | 84.9 | 30.8 | 111.4 | 19.9 | 67.9 | 20.5 | 60.5 | 13.6 |
| AD-413991 | 28.8 | 3.6 | 150.5 | 33.6 | 126.3 | 51.2 | 75.0 | 23.9 | 103.8 | 18.8 | 105.1 | 33.1 | 82.6 | 23.3 | 93.8 | 57.1 |
| AD-413993 | 15.0 | 3.1 | 90.2 | 16.4 | 82.4 | 34.2 | 51.9 | 5.8 | 64.5 | 18.9 | 92.7 | 26.9 | 138.4 | 33.8 | 86.4 | 4.4 |
| AD-414002 | 10.7 | 3.7 | 75.6 | 14.4 | 177.2 | 4.2 | 121.9 | 36.3 | 57.0 | 19.7 | 99.8 | 28.3 | 63.1 | 34.7 | 78.2 | 13.8 |
| AD-416175 | 22.3 | 2.5 | 56.8 | 9.4 | 96.2 | 37.9 | 102.4 | 14.1 | 111.1 | 30.2 | 104.8 | 30.9 | 38.8 | 19.2 | 50.8 | 22.2 |
| AD-414044 | 9.3 | 1.8 | 109.4 | 15.3 | 138.1 | 59.2 | 92.0 | 16.1 | 97.0 | 26.9 | 123.6 | 24.8 | 69.5 | 20.8 | 68.9 | 31.7 |
| AD-414020 | 7.3 | 0.9 | 49.6 | 8.6 | 59.4 | 39.7 | 69.5 | 26.7 | 37.4 | 8.2 | 82.3 | 16.0 | 79.1 | 42.6 | 93.7 | 50.4 |
| AD-414047 | 6.9 | 0.9 | 22.7 | 5.9 | 47.8 | 46.9 | 55.0 | 45.4 | 49.6 | 0.7 | 102.9 | 23.2 | 40.1 | 13.2 | 75.4 | 16.1 |
| AD-414025 | 7.0 | 2.3 | 24.7 | 6.4 | 127.6 | 106.0 | 108.9 | 64.0 | 82.3 | 11.4 | 97.1 | 13.2 | 109.9 | 32.0 | 103.2 | 45.6 |
| AD-414026 | 6.8 | 1.1 | 42.0 | 13.9 | 144.0 | 61.8 | 85.0 | 15.8 | 55.2 | 8.9 | 94.1 | 22.4 | 64.3 | 7.5 | 75.2 | 25.5 |
| AD-414055 | 8.5 | 3.3 | 48.4 | 5.2 | 141.2 | 124.0 | 125.5 | 56.0 | 79.2 | 17.3 | 135.9 | 11.6 | 101.3 | 51.6 | 72.7 | 20.6 |
| AD-416632 | 18.9 | 4.2 | 98.0 | 11.9 | 94.4 | 15.1 | 64.3 | 9.4 | 82.4 | 18.4 | 109.8 | 27.7 | 80.4 | 2.5 | 59.3 | 4.0 |
| AD-416604 | 16.2 | 4.6 | 91.4 | 18.3 | 150.2 | 54.3 | 62.9 | 16.9 | 110.4 | 20.6 | 126.6 | 10.8 | 62.4 | 10.5 | 92.7 | 52.7 |
| AD-416651 | 8.8 | 3.1 | 35.0 | 8.5 | 159.2 | 75.3 | 83.1 | 50.3 | 42.3 | 11.1 | 95.1 | 32.3 | 62.7 | 25.2 | 99.7 | 53.4 |
| AD-417251 | 27.7 | 6.3 | 71.7 | 10.4 | 200.7 | 110.6 | 75.1 | 8.3 | 121.0 | 29.2 | 120.2 | 13.7 | 85.9 | 38.2 | 71.6 | 34.0 |
| AD-417255 | 19.3 | 2.4 | 73.0 | 8.7 | 140.6 | 125.3 | 64.4 | 22.9 | 91.2 | 14.5 | 131.4 | 21.9 | 77.5 | 19.7 | 97.1 | 33.1 |
| AD-414139 | 5.4 | 1.0 | 117.4 | 32.3 | 94.0 | 42.3 | 131.3 | 45.2 | 71.3 | 0.4 | 136.8 | 23.7 | 88.3 | 34.0 | 70.9 | 16.8 |
| AD-414104 | 3.9 | 1.1 | 33.6 | 9.1 | 58.4 | 56.3 | 68.2 | 44.9 | 76.6 | 22.2 | 102.5 | 32.5 | 70.8 | 36.4 | 67.7 | 36.0 |
| AD-414146 | 8.9 | 1.0 | 68.8 | 2.6 | 76.0 | 31.8 | 114.3 | 22.8 | 60.0 | 24.0 | 114.0 | 11.4 | 41.2 | 8.0 | 91.4 | 21.0 |
| AD-414151 | 14.1 | 4.8 | 93.9 | 23.6 | 42.5 | 20.7 | 82.0 | 39.8 | 44.4 | 10.9 | 98.6 | 20.9 | 101.0 | 26.1 | 71.8 | 16.3 |
| AD-414152 | 10.0 | 2.5 | 54.6 | 11.9 | 31.2 | 13.2 | 40.7 | 22.0 | 51.1 | 5.3 | 91.8 | 20.7 | 95.7 | 6.6 | 105.9 | 29.5 |
| AD-414112 | 9.9 | 2.6 | 43.5 | 9.1 | 68.3 | 74.4 | 90.3 | 17.3 | 45.7 | 6.8 | 89.1 | 12.9 | 96.4 | 8.6 | 110.5 | 15.2 |
| AD-414113 | 6.1 | 0.9 | 28.7 | 2.7 | 66.2 | 38.0 | 58.3 | 16.3 | 35.1 | 11.2 | 66.8 | 5.9 | 67.6 | 19.2 | 61.1 | 16.9 |
| AD-417711 | 15.9 | 4.0 | 60.8 | 15.8 | 99.0 | 97.3 | 120.6 | 22.5 | 108.0 | 28.2 | 133.5 | 37.9 | 85.4 | 30.1 | 76.4 | 26.4 |
| AD-417736 | 15.5 | 1.6 | 82.0 | 13.5 | 76.5 | 15.7 | 81.7 | 21.5 | 112.3 | 10.4 | 92.5 | 28.1 | 73.6 | 51.2 | 83.4 | 45.8 |
| AD-417714 | 20.9 | 3.0 | 83.0 | 26.9 | 81.0 | 24.2 | 68.1 | 36.8 | 96.5 | 11.3 | 109.1 | 33.1 | 75.0 | 22.6 | 96.3 | 38.3 |
| AD-414171 | 5.4 | 1.1 | 39.2 | 16.4 | 48.0 | 47.1 | 131.8 | 71.4 | 66.3 | 14.1 | 80.0 | 20.8 | 130.3 | 68.8 | 118.2 | 55.8 |
| AD-417864 | 14.0 | 3.8 | 45.1 | 5.6 | 106.7 | 20.2 | 147.5 | 92.5 | 77.8 | 8.1 | 150.5 | 30.3 | 224.3 | 27.1 | 75.5 | 5.3 |
| AD-418094 | 19.1 | 3.4 | 64.9 | 8.9 | 33.9 | 3.7 | 72.4 | 46.8 | 66.7 | 16.8 | 113.4 | 31.8 | 39.3 | 12.0 | 59.1 | 17.3 |
| AD-418067 | 18.6 | 1.2 | 58.0 | 10.2 | 83.5 | 27.1 | 81.1 | 35.0 | 82.7 | 24.9 | 118.3 | 20.2 | 83.0 | 23.3 | 92.8 | 27.9 |
| AD-418096 | 13.9 | 1.9 | 35.6 | 11.4 | 76.8 | 61.3 | 86.5 | 4.3 | 89.2 | 21.6 | 115.0 | 29.4 | 62.0 | 14.0 | 55.6 | 17.6 |
| AD-418097 | 17.3 | 4.4 | 47.3 | 14.3 | 85.4 | 53.7 | 75.9 | 10.5 | 95.7 | 23.9 | 88.1 | 15.3 | 81.1 | 7.5 | 93.7 | 31.4 |
| AD-418098 | 15.5 | 2.5 | 50.8 | 10.7 | 98.6 | 63.3 | 66.4 | 12.0 | 83.1 | 8.9 | 84.2 | 13.4 | 68.1 | 25.6 | 85.1 | 57.6 |
| AD-418100 | 12.7 | 1.3 | 40.8 | 9.8 | 73.1 | 50.3 | 69.6 | 29.1 | 82.5 | 12.3 | 109.9 | 20.0 | 65.4 | 23.1 | 70.2 | 34.0 |
| AD-414262 | 8.2 | 0.6 | 44.4 | 13.2 | 98.0 | 43.6 | 65.1 | 9.1 | 71.6 | 19.1 | 112.6 | 38.0 | 73.3 | 24.7 | 58.8 | 24.9 |
| AD-414263 | 26.2 | 4.5 | 84.8 | 19.8 | 82.8 | 26.8 | 34.6 | 16.6 | 110.3 | 37.3 | 125.7 | 23.8 | 98.6 | 26.1 | 93.6 | 5.0 |
| AD-414245 | 6.3 | 1.1 | 22.2 | 6.9 | 81.5 | 54.4 | 74.1 | 10.6 | 99.7 | 27.5 | 100.5 | 30.5 | 113.3 | 47.9 | 124.2 | 46.9 |
| AD-414265 | 12.2 | 6.1 | 35.4 | 6.8 | 60.4 | 22.8 | 62.5 | 28.4 | 102.1 | 15.3 | 113.9 | 34.6 | 123.4 | 28.0 | 62.1 | 8.9 |
| AD-414266 | 10.8 | 2.6 | 64.9 | 11.2 | 77.5 | 32.0 | 77.9 | 21.6 | 83.8 | 16.5 | 122.8 | 9.3 | 73.0 | 59.2 | 98.4 | 61.4 |
| AD-414267 | 9.8 | 1.8 | 54.5 | 11.3 | 29.0 | 7.5 | 229.7 | 59.0 | 90.4 | 8.5 | 107.1 | 25.9 | 62.8 | 34.3 | 85.1 | 22.3 |
| AD-414268 | 5.8 | 1.4 | 21.9 | 2.6 | 26.4 | 8.9 | 113.2 | 93.8 | 38.5 | 15.6 | 60.8 | 12.6 | 116.3 | 38.7 | 91.1 | 28.8 |
| AD-414288 | 10.8 | 3.4 | 53.1 | 15.2 | 54.3 | 16.8 | 99.1 | 21.3 | 51.6 | 16.2 | 67.8 | 16.4 | 58.6 | 18.5 | 68.7 | 27.2 |
| AD-414300 | 10.0 | 1.5 | 113.0 | 11.8 | 59.0 | 17.2 | 48.8 | 15.3 | 98.6 | 11.8 | 65.5 | 5.5 | 64.7 | 7.7 | 70.7 | 16.1 |
| AD-414301 | 8.8 | 2.3 | 75.1 | 22.3 | 128.1 | 47.2 | 89.5 | 48.5 | 86.8 | 19.5 | 115.1 | 15.0 | 51.0 | 31.0 | 80.9 | 10.8 |

TABLE 3-continued

ATXN 3 data_in vitro screen in Cos-7 (Human Dual-Luciferase psiCHECK2
vector) and Endogenous Cell Systems using the Duplexes of Table 2

| Duplex Name | Neuro 2A 10 nM | SD | Neuro 2A 0.1 nM | SD | Hep3b 10 nM | SD | Hep3b 0.1 nM | SD | Be(2)C 10 nM | SD | Be(2)C 0.1 nM | SD | DL UTR 10 nM | SD | DL UTR 0.1 nM | SD |
|---|---|---|---|---|---|---|---|---|---|---|---|---|---|---|---|---|
| AD-414343 | 13.0 | 1.4 | 92.7 | 27.8 | 51.1 | 8.1 | 85.1 | 17.1 | 84.5 | 11.0 | 89.2 | 16.4 | 42.6 | 24.3 | 117.8 | 39.1 |
| AD-414344 | 9.3 | 2.0 | 80.5 | 8.0 | 52.1 | 8.9 | 82.9 | 27.6 | 56.7 | 16.5 | 77.9 | 11.4 | 54.3 | 11.8 | 108.0 | 78.9 |
| AD-414345 | 12.6 | 5.4 | 78.7 | 30.4 | 67.1 | 23.1 | 95.1 | 0.5 | 83.6 | 9.7 | 96.0 | 26.1 | 85.2 | 7.5 | 146.1 | 2.1 |
| AD-414319 | 8.9 | 1.2 | 77.0 | 13.0 | 247.9 | 112.8 | 67.2 | 45.8 | 43.0 | 17.0 | 102.1 | 18.0 | 117.6 | 47.7 | 90.4 | 18.6 |
| AD-414353 | 34.2 | 2.8 | 129.3 | 7.0 | 75.4 | 20.4 | 63.8 | 14.0 | 86.4 | 21.2 | 133.4 | 8.5 | 89.3 | 25.8 | 85.1 | 28.6 |
| AD-414354 | 6.9 | 1.6 | 47.8 | 6.9 | 130.5 | 104.9 | 95.1 | 48.8 | 38.9 | 4.3 | 88.1 | 22.6 | 49.5 | 37.7 | 110.3 | 14.9 |
| AD-414320 | 6.4 | 3.4 | 28.2 | 5.2 | 70.3 | 32.0 | 104.3 | 30.2 | 44.4 | 7.0 | 72.8 | 13.8 | 97.8 | 37.3 | 67.8 | 44.2 |
| AD-414355 | 4.5 | 0.7 | 48.1 | 16.1 | 164.4 | 103.9 | 86.6 | 25.6 | 46.7 | 19.7 | 82.9 | 16.8 | 89.1 | 15.1 | 63.6 | 15.7 |
| AD-414356 | 4.6 | 1.3 | 27.8 | 9.4 | 18.1 | 8.9 | 93.5 | 25.8 | 38.0 | 2.5 | 113.0 | 44.8 | 59.3 | 11.8 | 86.7 | 22.8 |
| AD-414359 | 6.7 | 1.1 | 35.8 | 5.4 | 30.6 | 15.8 | 75.7 | 54.9 | 51.3 | 11.0 | 68.8 | 21.7 | 62.9 | 30.5 | 58.5 | 7.5 |
| AD-414322 | 10.3 | 3.3 | 39.1 | 9.0 | 22.8 | 13.5 | 114.3 | 16.2 | 38.9 | 3.5 | 76.3 | 17.4 | 68.2 | 6.8 | 41.2 | 2.4 |
| AD-413834 | 31.2 | 4.1 | 97.2 | 12.6 | 86.6 | 15.8 | 66.7 | 15.8 | 98.2 | 19.3 | 95.7 | 17.6 | 67.2 | 31.0 | 69.0 | 1.6 |
| AD-413843 | 24.0 | 2.2 | 101.7 | 16.8 | 47.3 | 7.9 | 100.8 | 47.0 | 67.3 | 7.1 | 126.5 | 33.6 | 76.1 | 38.6 | 78.8 | 11.0 |
| AD-414563 | 9.5 | 0.9 | 78.4 | 15.0 | 167.5 | 60.7 | 90.1 | 36.5 | 68.6 | 17.1 | 101.0 | 5.5 | 100.9 | 65.6 | 65.7 | 12.3 |
| AD-414564 | 15.2 | 3.6 | 79.0 | 17.6 | 80.8 | 22.8 | 88.1 | 41.8 | 72.0 | 10.0 | 94.6 | 19.6 | 61.9 | 37.7 | 58.4 | 11.3 |
| AD-414566 | 6.8 | 0.9 | 54.1 | 9.9 | 71.0 | 10.5 | 82.4 | 24.2 | 44.1 | 6.8 | 61.9 | 13.2 | 111.9 | 73.0 | 75.4 | 31.5 |
| AD-414534 | 11.6 | 0.8 | 95.3 | 18.3 | 84.1 | 27.1 | 101.9 | 17.3 | 55.8 | 22.8 | 92.0 | 17.8 | 79.7 | 32.4 | 72.3 | 4.6 |
| AD-413817 | 32.2 | 8.7 | 113.5 | 26.1 | 111.1 | 42.8 | 82.2 | 32.0 | 75.8 | 14.1 | 90.6 | 6.8 | 70.3 | 41.5 | 73.3 | 13.0 |
| AD-413849 | 29.3 | 6.3 | 115.8 | 21.6 | 89.9 | 23.1 | 94.2 | 16.4 | 88.9 | 26.3 | 88.8 | 27.6 | 78.0 | 9.1 | 130.2 | 43.9 |
| AD-414619 | 11.3 | 1.6 | 81.4 | 16.1 | 136.8 | 18.0 | 149.1 | 41.0 | 56.2 | 13.1 | 103.7 | 16.4 | 76.7 | 32.9 | 137.5 | 22.8 |

TABLE 4A

Human ATXN3 unmodified duplex Sequences
Sequences are indicated as "human" sequences as they are mapped onto the human ATXN3
sequence NM_001127697.2. Duplexes
listed in the table may be cross reactive with other species.

| Duplex Name | Sense strand sequence | SEQ ID NO | Range (NM_001127697.2) | Antisense strand sequence | SEQ ID NO | Range (NM_001127697.2) |
|---|---|---|---|---|---|---|
| AD-368021 | UUGGCUCCAGACAAAUAAACA | 703 | 50-70 | UGUUUAUUUGUCUGGAGCCAACG | 839 | 48-70 |
| AD-368023 | GGCUCCAGACAAAUAAACAUU | 704 | 52-72 | AAUGUUUAUUUGUCUGGAGCCAA | 840 | 50-72 |
| AD-368024 | GCUCCAGACAAAUAAACAUGU | 705 | 53-73 | ACAUGUUAUUUGUCUGGAGCCA | 841 | 51-73 |
| AD-368025 | CUCCAGACAAAUAAACAUGGA | 706 | 54-74 | UCCAUGUUUAUUUGUCUGGAGCC | 842 | 52-74 |
| AD-368027 | CCAGACAAAUAAACAUGGAGU | 707 | 56-76 | ACUCCAUGUUUAUUUGUCUGGAG | 843 | 54-76 |
| AD-368028 | CAGACAAAUAAACAUGGAGUU | 708 | 57-77 | AACUCCAUGUUUAUUUGUCUGGA | 844 | 55-77 |
| AD-368029 | AGACAAAUAAACAUGGAGUCU | 709 | 58-78 | AGACUCCAUGUUUAUUUGUCUGG | 845 | 56-78 |
| AD-368044 | GAGUCCAUCUUCCACGAGAAA | 710 | 73-93 | UUUCUCGUGGAAGAUGGACUCCA | 846 | 71-93 |
| AD-368047 | UCCAUCUUCCACGAGAAACAA | 711 | 76-96 | UUGUUUCUCGUGGAAGAUGGACU | 847 | 74-96 |
| AD-368049 | CAUCUUCCACGAGAAACAAGA | 712 | 78-98 | UCUUGUUUCUCGUGGAAGAUGGA | 848 | 76-98 |
| AD-368050 | AUCUUCCACGAGAAACAAGAA | 713 | 79-99 | UUCUUGUUUCUCGUGGAAGAUGG | 849 | 77-99 |
| AD-368052 | CUUCCACGAGAAACAAGAAGU | 714 | 81-101 | ACUUCUUGUUUCUCGUGGAAGAU | 850 | 79-101 |
| AD-368053 | UUCCACGAGAAACAAGAAGGU | 715 | 82-102 | ACCUUCUUGUUUCUCGUGGAAGA | 851 | 80-102 |
| AD-368055 | CCACGAGAAACAAGAAGGCUU | 716 | 84-104 | AAGCCUUCUUGUUUCUCGUGGAA | 852 | 82-104 |
| AD-368223 | UACAGCAGCCUUCUGGAAAUA | 717 | 254-274 | UAUUUCCAGAAGGCUGCUGUAAA | 853 | 252-274 |
| AD-368225 | CAGCAGCCUUCUGGAAAUAUU | 718 | 256-276 | AAUAUUUCCAGAAGGCUGCUGUA | 854 | 254-276 |
| AD-368226 | AGCAGCCUUCUGGAAAUAUGU | 719 | 257-277 | ACAUAUUCCAGAAGGCUGCUGU | 855 | 255-277 |
| AD-368250 | UUCAGUGGUUUAACUUGAAUU | 720 | 299-319 | AAUUCAAGUUAAACCACUGAAUA | 856 | 297-319 |
| AD-368251 | UCAGUGGUUUAACUUGAAUUU | 721 | 300-320 | AAAUUCAAGUUAAACCACUGAAU | 857 | 298-320 |

Human ATXN3 unmodified duplex Sequences
Sequences are indicated as "human" sequences as they are mapped onto the human ATXN3
sequence NM_001127697.2. Duplexes
listed in the table may be cross reactive with other species.

| Duplex Name | Sense strand sequence | SEQ ID NO | Range (NM_001127697.2) | Antisense strand sequence | SEQ ID NO | Range (NM_001127697.2) |
|---|---|---|---|---|---|---|
| AD-368252 | CAGUGGUUUAACUUGAAUUCU | 722 | 301-321 | AGAAUUCAAGUUAAACCACUGAA | 858 | 299-321 |
| AD-368253 | AGUGGUUUAACUUGAAUUCUU | 723 | 302-322 | AAGAAUUCAAGUUAAACCACUGA | 859 | 300-322 |
| AD-368337 | AGGAAGGUUAUUCUAUAUUUG | 724 | 386-406 | CAAAUAUAGAAUAACCUUCCUGU | 860 | 384-406 |
| AD-368338 | GGAAGGUUAUUCUAUAUUUGU | 725 | 387-407 | ACAAAUAUAGAAUAACCUUCCUG | 861 | 385-407 |
| AD-368339 | GAAGGUUAUUCUAUAUUUGUU | 726 | 388-408 | AACAAAUAUAGAAUAACCUUCCU | 862 | 386-408 |
| AD-368427 | AUCGACCAAAACUUAUUGGAU | 727 | 476-496 | AUCCAAUAAGUUUUGGUCGAUGC | 863 | 474-496 |
| AD-368428 | UCGACCAAAACUUAUUGGAGA | 728 | 477-497 | UCUCCAAUAAGUUUUGGUCGAUG | 864 | 475-497 |
| AD-368429 | CGACCAAAACUUAUUGGAGAA | 729 | 478-498 | UUCUCCAAUAAGUUUUGGUCGAU | 865 | 476-498 |
| AD-368721 | ACGAGAAGCCUACUUUGAAAA | 730 | 768-788 | UUUUCAAAGUAGGCUUCUCGUCU | 866 | 766-788 |
| AD-368722 | CGAGAAGCCUACUUUGAAAAA | 731 | 769-789 | UUUUUCAAAGUAGGCUUCUCGUC | 867 | 767-789 |
| AD-368810 | CUUGGGAGUGAUCUAGGUGAU | 732 | 892-912 | AUCACCUAGAUCACUCCCAAGUG | 868 | 890-912 |
| AD-368811 | UUGGGAGUGAUCUAGGUGAUU | 733 | 893-913 | AAUCACCUAGAUCACUCCCAAGU | 869 | 891-913 |
| AD-368814 | GGAGUGAUCUAGGUGAUGCUA | 734 | 896-916 | UAGCAUCACCUAGAUCACUCCCA | 870 | 894-916 |
| AD-368815 | GAGUGAUCUAGGUGAUGCUAU | 735 | 897-917 | AUAGCATCACCUAGAUCACUCCC | 871 | 895-917 |
| AD-368866 | GACCAUGUCUUUAGAAACUGU | 736 | 948-968 | ACAGUUUCUAAAGACAUGGUCAC | 872 | 946-968 |
| AD-368867 | ACCAUGUCUUUAGAAACUGUU | 737 | 949-969 | AACAGUUUCUAAAGACAUGGUCA | 873 | 947-969 |
| AD-368868 | CCAUGUCUUUAGAAACUGUCA | 738 | 950-970 | UGACAGUUUCUAAAGACAUGGUC | 874 | 948-970 |
| AD-368869 | CAUGUCUUUAGAAACUGUCAU | 739 | 951-971 | AUGACAGUUUCUAAAGACAUGGU | 875 | 949-971 |
| AD-368871 | UGUCUUUAGAAACUGUCAGAA | 740 | 953-973 | UUCUGACAGUUUCUAAAGACAUG | 876 | 951-973 |
| AD-368872 | GUCUUUAGAAACUGUCAGAAA | 741 | 954-974 | UUUCUGACAGUUUCUAAAGACAU | 877 | 952-974 |
| AD-368887 | CAGAAAUGAUUUGAAAACAGA | 742 | 969-989 | UCUGUUUUCAAAUCAUUUCUGAC | 878 | 967-989 |
| AD-368891 | AAUGAUUUGAAAACAGAAGGA | 743 | 973-993 | UCCUUCUGUUUUCAAAUCAUUUC | 879 | 971-993 |
| AD-368991 | UUUUAGCGGUUUGCAAACAAA | 744 | 1109-1129 | UUUGUUUGCAAACCGCUAAAAGU | 880 | 1107-1129 |
| AD-368992 | UUUAGCGGUUUGCAAACAAAA | 745 | 1110-1130 | UUUUGUUUGCAAACCGCUAAAAG | 881 | 1108-1130 |
| AD-368993 | UUAGCGGUUUGCAAACAAAAU | 746 | 1111-1131 | AUUUUGUUUGCAAACCGCUAAAA | 882 | 1109-1131 |
| AD-368994 | UAGCGGUUUGCAAACAAAAUU | 747 | 1112-1132 | AAUUUUGUUUGCAAACCGCUAAA | 883 | 1110-1132 |
| AD-368995 | AGCGGUUUGCAAACAAAAUGA | 748 | 1113-1133 | UCAUUUUGUUUGCAAACCGCUAA | 884 | 1111-1133 |
| AD-368996 | GCGGUUUGCAAACAAAAUGAU | 749 | 1114-1134 | AUCAUUUUGUUUGCAAACCGCUA | 885 | 1112-1134 |
| AD-368999 | GUUUGCAAACAAAAUGAUGGU | 750 | 1117-1137 | ACCAUCAUUUUGUUUGCAAACCG | 886 | 1115-1137 |
| AD-369000 | UUUGCAAACAAAAUGAUGGGA | 751 | 1118-1138 | UCCCAUCAUUUUGUUUGCAAACC | 887 | 1116-1138 |
| AD-369082 | GCAUUCAGCAAUUAAAGACAU | 752 | 1200-1220 | AUGUCUUAAUUGCUGAAUGCCU | 888 | 1198-1220 |
| AD-369083 | CAUUCAGCAAUUAAAGACAUU | 753 | 1201-1221 | AAUGUCUUUAAUUGCUGAAUGCC | 889 | 1199-1221 |
| AD-369170 | UUUGCAGACUAGCUAAUUAGU | 754 | 1308-1328 | ACUAAUUAGCUAGUCUGCAAAA | 890 | 1306-1328 |
| AD-369171 | UUGCAGACUAGCUAAUUAGCU | 755 | 1309-1329 | AGCUAAUUAGCUAGUCUGCAAAA | 891 | 1307-1329 |
| AD-369172 | UGCAGACUAGCUAAUUAGCUU | 756 | 1310-1330 | AAGCUAAUUAGCUAGUCUGCAAA | 892 | 1308-1330 |
| AD-369173 | GCAGACUAGCUAAUUAGCUCU | 757 | 1311-1331 | AGAGCUAAUUAGCUAGUCUGCAA | 893 | 1309-1331 |

TABLE 4A-continued

Human ATXN3 unmodified duplex Sequences
Sequences are indicated as "human" sequences as they are mapped onto the human ATXN3
sequence NM_001127697.2. Duplexes
listed in the table may be cross reactive with other species.

| Duplex Name | Sense strand sequence | SEQ ID NO | Range (NM_001127697.2) | Antisense strand sequence | SEQ ID NO | Range (NM_001127697.2) |
|---|---|---|---|---|---|---|
| AD-369174 | CAGACUAGCUAAUUAGCUCUU | 758 | 1312-1332 | AAGAGCUAAUUAGCUAGUCUGCA | 894 | 1310-1332 |
| AD-369314 | GAUGUUGAUAAUAGUAAUGGU | 759 | 1463-1483 | ACCAUUACUAUUAUCAACAUCAG | 895 | 1461-1483 |
| AD-369315 | AUGUUGAUAAUAGUAAUGGUU | 760 | 1464-1484 | AACCAUUACUAUUAUCAACAUCA | 896 | 1462-1484 |
| AD-369316 | UGUUGAUAAUAGUAAUGGUUU | 761 | 1465-1485 | AAACCAUUACUAUUAUCAACAUC | 897 | 1463-1485 |
| AD-369317 | GUUGAUAAUAGUAAUGGUUCU | 762 | 1466-1486 | AGAACCAUUACUAUUAUCAACAU | 898 | 1464-1486 |
| AD-369318 | UUGAUAAUAGUAAUGGUUCUA | 763 | 1467-1487 | UAGAACCAUUACUAUUAUCAACA | 899 | 1465-1487 |
| AD-369319 | UGAUAAUAGUAAUGGUUCUAU | 764 | 1468-1488 | AUAGAACCAUUACUAUUAUCAAC | 900 | 1466-1488 |
| AD-369409 | UUUCUGCUACCUGGUUUUCAU | 765 | 1566-1586 | AUGAAAACCAGGUAGCAGAAAAG | 901 | 1564-1586 |
| AD-369410 | UUCUGCUACCUGGUUUUCAUU | 766 | 1567-1587 | AAUGAAAACCAGGUAGCAGAAAA | 902 | 1565-1587 |
| AD-369411 | UCUGCUACCUGGUUUUCAUUA | 767 | 1568-1588 | UAAUGAAAACCAGGUAGCAGAAA | 903 | 1566-1588 |
| AD-369414 | GCUACCUGGUUUUCAUUAUUU | 768 | 1571-1591 | AAAUAAUGAAAACCAGGUAGCAG | 904 | 1569-1591 |
| AD-369417 | ACCUGGUUUUCAUUAUUUUCU | 769 | 1574-1594 | AGAAAAUAAUGAAAACCAGGUAG | 905 | 1572-1594 |
| AD-369418 | CCUGGUUUUCAUUAUUUUCCU | 770 | 1575-1595 | AGGAAAAUAAUGAAAACCAGGUA | 906 | 1573-1595 |
| AD-369419 | CUGGUUUUCAUUAUUUUCCCA | 771 | 1576-1596 | UGGGAAAAUAAUGAAAACCAGGU | 907 | 1574-1596 |
| AD-369420 | UGGUUUUCAUUAUUUUCCCAU | 772 | 1577-1597 | AUGGGAAAAUAAUGAAAACCAGG | 908 | 1575-1597 |
| AD-369421 | GGUUUUCAUUAUUUUCCCACA | 773 | 1578-1598 | UGUGGGAAAAUAAUGAAAACCAG | 909 | 1576-1598 |
| AD-369423 | UUUUCAUUAUUUUCCCACAAU | 774 | 1580-1600 | AUUGUGGGAAAAUAAUGAAAACC | 910 | 1578-1600 |
| AD-369424 | UUUCAUUAUUUUCCCACAAUU | 775 | 1581-1601 | AAUUGUGGGAAAAUAAUGAAAAC | 911 | 1579-1601 |
| AD-369426 | UCAUUAUUUUCCCACAAUUCU | 776 | 1583-1603 | AGAAUUGUGGGAAAAUAAUGAAA | 912 | 1581-1603 |
| AD-369428 | AUUAUUUUCCCACAAUUCUUU | 777 | 1585-1605 | AAAGAAUUGUGGGAAAAUAAUGA | 913 | 1583-1605 |
| AD-369429 | UUAUUUUCCCACAAUUCUUUU | 778 | 1586-1606 | AAAAGAAUUGUGGGAAAAUAAUG | 914 | 1584-1606 |
| AD-369430 | UAUUUUCCCACAAUUCUUUUG | 779 | 1587-1607 | CAAAAGAAUUGUGGGAAAAUAAU | 915 | 1585-1607 |
| AD-369431 | AUUUUCCCACAAUUCUUUUGA | 780 | 1588-1608 | UCAAAAGAAUUGUGGGAAAAUAA | 916 | 1586-1608 |
| AD-369432 | UUUUCCCACAAUUCUUUUGAA | 781 | 1589-1609 | UUCAAAAGAAUUGUGGGAAAAUA | 917 | 1587-1609 |
| AD-369433 | UUUCCCACAAUUCUUUUGAAA | 782 | 1590-1610 | UUUCAAAAGAAUUGUGGGAAAAU | 918 | 1588-1610 |
| AD-369434 | UUCCCACAAUUCUUUUGAAAU | 783 | 1591-1611 | AUUUCAAAAGAAUUGUGGGAAAA | 919 | 1589-1611 |
| AD-369435 | UCCCACAAUUCUUUUGAAAGA | 784 | 1592-1612 | UCUUUCAAAAGAAUUGUGGGAAA | 920 | 1590-1612 |
| AD-369437 | CCACAAUUCUUUUGAAAGAUU | 785 | 1594-1614 | AAUCUUUCAAAAGAAUUGUGGGA | 921 | 1592-1614 |
| AD-369445 | CUUUUGAAAGAUGGUAAUCUU | 786 | 1602-1622 | AAGAUUACCAUCUUUCAAAAGAA | 922 | 1600-1622 |
| AD-369446 | UUUUGAAAGAUGGUAAUCUUU | 787 | 1603-1623 | AAAGAUUACCAUCUUUCAAAAGA | 923 | 1601-1623 |
| AD-369447 | UUUGAAAGAUGGUAAUCUUUU | 788 | 1604-1624 | AAAAGAUUACCAUCUUUCAAAAG | 924 | 1602-1624 |
| AD-369448 | UUGAAAGAUGGUAAUCUUUUC | 789 | 1605-1625 | GAAAAGAUUACCAUCUUUCAAAA | 925 | 1603-1625 |
| AD-369449 | UGAAAGAUGGUAAUCUUUUCU | 790 | 1606-1626 | AGAAAAGAUUACCAUCUUUCAAA | 926 | 1604-1626 |
| AD-369450 | GAAAGAUGGUAAUCUUUUCUU | 791 | 1607-1627 | AAGAAAAGAUUACCAUCUUUCAA | 927 | 1605-1627 |
| AD-369451 | AAAGAUGGUAAUCUUUUCUGA | 792 | 1608-1628 | UCAGAAAAGAUUACCAUCUUUCA | 928 | 1606-1628 |

TABLE 4A-continued

Human ATXN3 unmodified duplex Sequences
Sequences are indicated as "human" sequences as they are mapped onto the human ATXN3
sequence NM_001127697.2. Duplexes
listed in the table may be cross reactive with other species.

| Duplex Name | Sense strand sequence | SEQ ID NO | Range (NM_001127697.2) | Antisense strand sequence | SEQ ID NO | Range (NM_001127697.2) |
|---|---|---|---|---|---|---|
| AD-369513 | GACUGGUGCGUUCCUAAACUU | 793 | 1670-1690 | AAGUUUAGGAACGCACCAGUCAU | 929 | 1668-1690 |
| AD-369515 | CUGGUGCGUUCCUAAACUCUU | 794 | 1672-1692 | AAGAGUUAGGAACGCACCAGUC | 930 | 1670-1692 |
| AD-369516 | UGGUGCGUUCCUAAACUCUGA | 795 | 1673-1693 | UCAGAGUUUAGGAACGCACCAGU | 931 | 1671-1693 |
| AD-369517 | GGUGCGUUCCUAAACUCUGAA | 796 | 1674-1694 | UUCAGAGUUUAGGAACGCACCAG | 932 | 1672-1694 |
| AD-369518 | GUGCGUUCCUAAACUCUGAAA | 797 | 1675-1695 | UUUCAGAGUUUAGGAACGCACCA | 933 | 1673-1695 |
| AD-369519 | UGCGUUCCUAAACUCUGAAAU | 798 | 1676-1696 | AUUUCAGAGUUUAGGAACGCACC | 934 | 1674-1696 |
| AD-369559 | UUUAAAAUGUGUGAGCAUGUU | 799 | 1734-1754 | AACAUGCUCACACAUUUUAAAAA | 935 | 1732-1754 |
| AD-369560 | UUAAAAUGUGUGAGCAUGUGU | 800 | 1735-1755 | ACACAUGCUCACACAUUUUAAAA | 936 | 1733-1755 |
| AD-369568 | UGUGAGCAUGUGCUUUCCCAU | 801 | 1743-1763 | AUGGGAAAGCACAUGCUCACACA | 937 | 1741-1763 |
| AD-369569 | GUGAGCAUGUGCUUUCCCAGA | 802 | 1744-1764 | UCUGGGAAAGCACAUGCUCACAC | 938 | 1742-1764 |
| AD-369571 | GAGCAUGUGCUUUCCCAGAUU | 803 | 1746-1766 | AAUCUGGGAAAGCACAUGCUCAC | 939 | 1744-1766 |
| AD-369572 | AGCAUGUGCUUUCCCAGAUGU | 804 | 1747-1767 | ACAUCUGGGAAAGCACAUGCUCA | 940 | 1745-1767 |
| AD-369574 | CAUGUGCUUUCCCAGAUGCUU | 805 | 1749-1769 | AAGCAUCUGGGAAAGCACAUGCU | 941 | 1747-1769 |
| AD-369575 | AUGUGCUUUCCCAGAUGCUUU | 806 | 1750-1770 | AAAGCATCUGGGAAAGCACAUGC | 942 | 1748-1770 |
| AD-369576 | UGUGCUUUCCCAGAUGCUUUA | 807 | 1751-1771 | UAAAGCAUCUGGGAAAGCACAUG | 943 | 1749-1771 |
| AD-369579 | GCUUUCCCAGAUGCUUUAUGA | 808 | 1754-1774 | UCAUAAAGCAUCUGGGAAAGCAC | 944 | 1752-1774 |
| AD-369580 | CUUUCCCAGAUGCUUUAUGAA | 809 | 1755-1775 | UUCAUAAAGCAUCUGGGAAAGCA | 945 | 1753-1775 |
| AD-369581 | UUUCCCAGAUGCUUUAUGAAU | 810 | 1756-1776 | AUUCAUAAAGCAUCUGGGAAAGC | 946 | 1754-1776 |
| AD-369582 | UUCCCAGAUGCUUUAUGAAUU | 811 | 1757-1777 | AAUUCAUAAAGCAUCUGGGAAAG | 947 | 1755-1777 |
| AD-369606 | UUUCACUUAUAUCAAAACCUU | 812 | 1781-1801 | AAGGUUUUGAUAUAAGUGAAAG | 948 | 1779-1801 |
| AD-369609 | CACUUAUAUCAAAACCUUACA | 813 | 1784-1804 | UGUAAGGUUUUGAUAUAAGUGAA | 949 | 1782-1804 |
| AD-369611 | CUUAUAUCAAAACCUUACAGU | 814 | 1786-1806 | ACUGUAAGGUUUUGAUAUAAGUG | 950 | 1784-1806 |
| AD-369612 | UUAUAUCAAAACCUUACAGCU | 815 | 1787-1807 | AGCUGUAAGGUUUUGAUAUAAGU | 951 | 1785-1807 |
| AD-369614 | AUAUCAAAACCUUACAGCUUU | 816 | 1789-1809 | AAAGCUGUAAGGUUUUGAUAUAA | 952 | 1787-1809 |
| AD-369616 | AUCAAAACCUUACAGCUUUGU | 817 | 1791-1811 | ACAAAGCUGUAAGGUUUUGAUAU | 953 | 1789-1811 |
| AD-369617 | UCAAAACCUUACAGCUUUGUU | 818 | 1792-1812 | AACAAAGCUGUAAGGUUUUGAUA | 954 | 1790-1812 |
| AD-369618 | CAAAACCUUACAGCUUUGUUU | 819 | 1793-1813 | AAACAAAGCUGUAAGGUUUUGAU | 955 | 1791-1813 |
| AD-369619 | AAAACCUUACAGCUUUGUUGU | 820 | 1794-1814 | ACAACAAAGCUGUAAGGUUUUGA | 956 | 1792-1814 |
| AD-369620 | AAACCUUACAGCUUUGUUGCA | 821 | 1795-1815 | UGCAACAAAGCUGUAAGGUUUUG | 957 | 1793-1815 |
| AD-369621 | AACCUUACAGCUUUGUUGCAA | 822 | 1796-1816 | UUGCAACAAAGCUGUAAGGUUUU | 958 | 1794-1816 |
| AD-369622 | ACCUUACAGCUUUGUUGCAAU | 823 | 1797-1817 | AUUGCAACAAAGCUGUAAGGUUU | 959 | 1795-1817 |
| AD-369623 | CCUUACAGCUUUGUUGCAACU | 824 | 1798-1818 | AGUUGCAACAAAGCUGUAAGGUU | 960 | 1796-1818 |
| AD-369624 | CUUACAGCUUUGUUGCAACCU | 825 | 1799-1819 | AGGUUGCAACAAAGCUGUAAGGU | 961 | 1797-1819 |
| AD-369625 | CUUCUUCCUGCGCCUUAUUUU | 826 | 1820-1840 | AAAAUAAGGCGCAGGAAGAAGGG | 962 | 1818-1840 |
| AD-369626 | UUCUUCCUGCGCCUUAUUUUU | 827 | 1821-1841 | AAAAAUAAGGCGCAGGAAGAAGG | 963 | 1819-1841 |
| AD-369630 | CCUUUCUUCUCCAAUUGAGAA | 828 | 1843-1863 | UUCUCAAUUGGAGAAGAAAGGAA | 964 | 1841-1863 |

TABLE 4A-continued

Human ATXN3 unmodified duplex Sequences
Sequences are indicated as "human" sequences as they are mapped onto the human ATXN3
sequence NM_001127697.2. Duplexes
listed in the table may be cross reactive with other species.

| Duplex Name | Sense strand sequence | SEQ ID NO | Range (NM_001127697.2) | Antisense strand sequence | SEQ ID NO | Range (NM_001127697.2) |
|---|---|---|---|---|---|---|
| AD-369631 | CUUUCUUCUCCAAUUGAGAAA | 829 | 1844-1864 | UUUCUCAAUUGGAGAAGAAAGGA | 965 | 1842-1864 |
| AD-369632 | UUUCUUCUCCAAUUGAGAAAA | 830 | 1845-1865 | UUUUCUCAAUUGGAGAAGAAAGG | 966 | 1843-1865 |
| AD-369633 | UUCUUCUCCAAUUGAGAAAAU | 831 | 1846-1866 | AUUUUCTCAAUUGGAGAAGAAAG | 967 | 1844-1866 |
| AD-388251 | CAGUGGUUUAACUUGAAUUCU | 832 | 301-321 | AGAAUUCAAGUUAAACCACUGCU | 968 | |
| AD-388252 | AGUGGUUUAACUUGAAUUCUU | 833 | 302-322 | AAGAAUUCAAGUUAAACCACUGC | 969 | |
| AD-413817 | GAGUCCAUCUUCCACGAGAAA | 834 | 73-93 | UUUCUCGUGGAAGAUGGACUCCA | 970 | 71-93 |
| AD-414319 | CAACAGAUGCAUCGACCAAAA | 835 | 466-486 | UUUUGGUCGAUGCAUCUGUUGGA | 971 | 464-486 |
| AD-414320 | AGAUGCAUCGACCAAAACUUA | 836 | 470-490 | UAAGUUUUGGUCGAUGCAUCUGU | 972 | 468-490 |
| AD-414322 | UCGACCAAAACUUAUUGGAGA | 837 | 477-497 | UCUCCAAUAAGUUUUGGUCGAUG | 973 | 475-497 |
| AD-414534 | GUAUGCAAGGUAGUUCCAGAA | 838 | 683-703 | UUCUGGAACUACCUUGCAUACUG | 974 | |

TABLE 4B

Mouse ATXN3 unmodified duplex Sequences
Sequences are indicated as "mouse" sequences as they are mapped onto the mouse ATXN3 sequence
NM_029705.3. Duplexes listed in the table may be cross reactive with other species.

| Duplex Name | Unmodified sense sequence | SEQ ID NO | Range (NM_029705.3) | Unmodified antisense sequence | SEQ ID NO | Range (NM_029705.3) |
|---|---|---|---|---|---|---|
| AD-388257 | AGCAGUGGUUUAACUUGAAUU | 975 | 469-489 | AAUUCAAGUUAAACCACUGCUUG | 1069 | 467-489 |
| AD-388258 | GCAGUGGUUUAACUUGAAUUU | 976 | 470-490 | AAAUUCAAGUUAAACCACUGCUU | 1070 | 468-490 |
| AD-388330 | AAGAAGGUUAUUCUAUAUUUG | 977 | 556-576 | CAAAUAUAGAAUAACCUUCUUGC | 1071 | 554-576 |
| AD-388331 | AGAAGGUUAUUCUAUAUUUGU | 978 | 557-577 | ACAAAUAUAGAAUAACCUUCUUG | 1072 | 555-577 |
| AD-388403 | CGACCAAAACUUAUUGGAGAU | 979 | 648-668 | AUCUCCAAUAAGUUUUGGUCGAU | 1073 | 646-668 |
| AD-388693 | CGAGAAGCCUACUUUGAAAAU | 980 | 939-959 | AUUUUCAAAGUAGGCUUCUCGUC | 1074 | 937-959 |
| AD-413834 | GGCUCCAGACAAAUAAACAUA | 981 | 69-89 | UAUGUUUAUUUGUCUGGAGCCAA | 1075 | 67-89 |
| AD-413843 | AAUAAACAUGGAGUCCAUCUA | 982 | 80-100 | UAGAUGGACUCCAUGUUUAUUUG | 1076 | 78-100 |
| AD-413849 | AGUCCAUCUUCCACGAGAAAA | 983 | 91-111 | UUUUCUCGUGGAAGAUGGACUCC | 1077 | 89-111 |
| AD-413912 | UGCAAGGAGAGUAUUUUAGCA | 984 | 154-174 | UGCUAAAAUACUCUCCUUGCAAU | 1078 | 152-174 |
| AD-413913 | GCAAGGAGAGUAUUUUAGCCA | 985 | 155-175 | UGGCUAAAAUACUCUCCUUGCAA | 1079 | 153-175 |
| AD-413959 | GAAGACUACCGCACAUUUUUA | 986 | 252-272 | UAAAAAUGUGCGGUAGUCUUCAC | 1080 | 250-272 |
| AD-413960 | AGACUACCGCACAUUUUUACA | 987 | 254-274 | UGUAAAAAUGUGCGGUAGUCUUC | 1081 | 252-274 |
| AD-413961 | CUACCGCACAUUUUUACAGCA | 988 | 257-277 | UGCUGUAAAAAUGUGCGGUAGUC | 1082 | 255-277 |
| AD-413986 | GUGAAGACUACCGCACAUUUA | 989 | 250-270 | UAAAUGUGCGGUAGUCUUCACUA | 1083 | 248-270 |
| AD-413987 | UGAAGACUACCGCACAUUUUA | 990 | 251-271 | UAAAAUGUGCGGUAGUCUUCACU | 1084 | 249-271 |
| AD-413988 | AAGACUACCGCACAUUUUUAA | 991 | 253-273 | UUAAAAAUGUGCGGUAGUCUUCA | 1085 | 251-273 |
| AD-413990 | ACUACCGCACAUUUUUACAGA | 992 | 256-276 | UCUGUAAAAAUGUGCGGUAGUCU | 1086 | 254-276 |
| AD-413991 | UACCGCACAUUUUUACAGCAA | 993 | 258-278 | UUGCUGUAAAAAUGUGCGGUAGU | 1087 | 256-278 |

TABLE 4B-continued

Mouse ATXN3 unmodified duplex Sequences
Sequences are indicated as "mouse" sequences as they are mapped onto the mouse ATXN3 sequence
NM_029705.3. Duplexes listed in the table may be cross reactive with other species.

| Duplex Name | Unmodified sense sequence | SEQ ID NO | Range (NM_029705.3) | Unmodified antisense sequence | SEQ ID NO | Range (NM_029705.3) |
|---|---|---|---|---|---|---|
| AD-413993 | CCGCACAUUUUUACAGCAGCA | 994 | 260-280 | UGCUGCUGUAAAAAUGUGCGGUA | 1088 | 258-280 |
| AD-414002 | CAGCAGCCUUCUGGAAAUAUA | 995 | 273-293 | UAUAUUUCCAGAAGGCUGCUGUA | 1089 | 271-293 |
| AD-414020 | CAGCGGCUUUUUCUCUAUUCA | 996 | 299-319 | UGAAUAGAGAAAAAGCCGCUGUC | 1090 | 297-319 |
| AD-414025 | UCUCUAUUCAAGUUAUAAGCA | 997 | 310-330 | UGCUUAUAACUUGAAUAGAGAAA | 1091 | 308-330 |
| AD-414026 | CUCUAUUCAAGUUAUAAGCAA | 998 | 311-331 | UUGCUUAUAACUUGAAUAGAGAA | 1092 | 309-331 |
| AD-414044 | UGACAGCGGCUUUUUCUCUAA | 999 | 296-316 | UUAGAGAAAAGCCGCUGUCAUC | 1093 | 294-316 |
| AD-414047 | GCGGCUUUUUCUCUAUUCAAA | 1000 | 301-321 | UUUGAAUAGAGAAAAAGCCGCUG | 1094 | 299-321 |
| AD-414055 | UAUUCAAGUUAUAAGCAAUGA | 1001 | 314-334 | UCAUUGCUUAUAACUUGAAUAGA | 1095 | 312-334 |
| AD-414104 | AAGAUCCUUUAUAUGCAAUUA | 1002 | 413-433 | UAAUUGCAUAUAAAGGAUCUUUC | 1096 | 411-433 |
| AD-414112 | AACACUGGUUUACAGUUAGAA | 1003 | 439-459 | UUCUAACUGUAAACCAGUGUUCU | 1097 | 437-459 |
| AD-414113 | ACACUGGUUUACAGUUAGAAA | 1004 | 440-460 | UUUCUAACUGUAAACCAGUGUUC | 1098 | 438-460 |
| AD-414139 | AAAGAUCCUUUAUAUGCAAUA | 1005 | 412-432 | UAUUGCAUAUAAAGGAUCUUUCG | 1099 | 410-432 |
| AD-414146 | CAAUUAUAAAGAACACUGGUA | 1006 | 428-448 | UACCAGUGUUCUUUAUAAUUGCA | 1100 | 426-448 |
| AD-414151 | AAAGAACACUGGUUUACAGUA | 1007 | 435-455 | UACUGUAAACCAGUGUUCUUUAU | 1101 | 433-455 |
| AD-414152 | AGAACACUGGUUUACAGUUAA | 1008 | 437-457 | UUAACUGUAAACCAGUGUUCUUU | 1102 | 435-457 |
| AD-414171 | AGCAGUGGUUUAACUUGAAUA | 1009 | 469-489 | UAUUCAAGUUAAACCACUGCUUG | 1103 | 467-489 |
| AD-414245 | UACAGCAAGAAGGUUAUUCUA | 1010 | 550-570 | UAGAAUAACCUUCUUGCUGUAAU | 1104 | 548-570 |
| AD-414262 | AAUUACAGCAAGAAGGUUAUA | 1011 | 547-567 | UAUAACCUUCUUGCUGUAAUUGA | 1105 | 545-567 |
| AD-414263 | AUUACAGCAAGAAGGUUAUUA | 1012 | 548-568 | UAAUAACCUUCUUGCUGUAAUUG | 1106 | 546-568 |
| AD-414265 | ACAGCAAGAAGGUUAUUCUAA | 1013 | 551-571 | UUAGAAUAACCUUCUUGCUGUAA | 1107 | 549-571 |
| AD-414266 | AGCAAGAAGGUUAUUCUAUAA | 1014 | 553-573 | UUAUAGAAUAACCUUCUUGCUGU | 1108 | 551-573 |
| AD-414267 | GCAAGAAGGUUAUUCUAUAUA | 1015 | 554-574 | UAUAUAGAAUAACCUUCUUGCUG | 1109 | 552-574 |
| AD-414268 | CAAGAAGGUUAUUCUAUAUUA | 1016 | 555-575 | UAAUAUAGAAUAACCUUCUUGCU | 1110 | 553-575 |
| AD-414288 | AAGGGUGAUCUGCCAGAUUGA | 1017 | 582-602 | UCAAUCUGGCAGAUCACCCUUAA | 1111 | 580-602 |
| AD-414300 | UUGUGAAGCUGACCAACUUUA | 1018 | 599-619 | UAAAGUUGGUCAGCUUCACAAUC | 1112 | 597-619 |
| AD-414301 | UGUGAAGCUGACCAACUUUUA | 1019 | 600-620 | UAAAAGUUGGUCAGCUUCACAAU | 1113 | 598-620 |
| AD-414343 | CAGAUGAUCAAGGUCCAACAA | 1020 | 621-641 | UUGUUGGACCUUGAUCAUCUGCA | 1114 | 619-641 |
| AD-414344 | GAUGAUCAAGGUCCAACAGAA | 1021 | 623-643 | UUCUGUUGGACCUUGAUCAUCUG | 1115 | 621-643 |
| AD-414345 | AUGAUCAAGGUCCAACAGAUA | 1022 | 624-644 | UAUCUGUUGGACCUUGAUCAUCU | 1116 | 622-644 |
| AD-414353 | ACAGAUGCAUCGACCAAAACA | 1023 | 638-658 | UGUUUUGGUCGAUGCAUCUGUUG | 1117 | 636-658 |
| AD-414354 | CAGAUGCAUCGACCAAAACUA | 1024 | 639-659 | UAGUUUUGGUCGAUGCAUCUGUU | 1118 | 637-659 |
| AD-414355 | GAUGCAUCGACCAAAACUUAA | 1025 | 641-661 | UUAAGUUUUGGUCGAUGCAUCUG | 1119 | 639-661 |
| AD-414356 | AUGCAUCGACCAAAACUUAUA | 1026 | 642-662 | UAUAAGUUUUGGUCGAUGCAUCU | 1120 | 640-662 |
| AD-414359 | AUCGACCAAAACUUAUUGGAA | 1027 | 646-666 | UUCCAAUAAGUUUUGGUCGAUGC | 1121 | 644-666 |
| AD-414563 | UCAGCUCAGUAUGCAAGGUAA | 1028 | 845-865 | UUACCUUGCAUACUGAGCUGAAU | 1122 | 843-865 |
| AD-414564 | CAGCUCAGUAUGCAAGGUAGA | 1029 | 846-866 | UCUACCUUGCAUACUGAGCUGAA | 1123 | 844-866 |
| AD-414566 | GCUCAGUAUGCAAGGUAGUUA | 1030 | 848-868 | UAACUACCUUGCAUACUGAGCUG | 1124 | 846-868 |

TABLE 4B-continued

Mouse ATXN3 unmodified duplex Sequences
Sequences are indicated as "mouse" sequences as they are mapped onto the mouse ATXN3 sequence
NM_029705.3. Duplexes listed in the table may be cross reactive with other species.

| Duplex Name | Unmodified sense sequence | SEQ ID NO | Range (NM_029705.3) | Unmodified antisense sequence | SEQ ID NO | Range (NM_029705.3) |
|---|---|---|---|---|---|---|
| AD-414619 | CUACUUUGAAAAGCAACAGCA | 1031 | 947-967 | UGCUGUUGCUUUUCAAAGUAGGC | 1125 | 945-967 |
| AD-414943 | AGUGGUUUGUAAGCAGAAAGA | 1032 | 1262-1282 | UCUUUCUGCUUACAAACCACUAC | 1126 | 1260-1282 |
| AD-414983 | AAGAGGCAGUCAGCAAUGAAA | 1033 | 1327-1347 | UUUCAUUGCUGACUGCCUCUUUG | 1127 | 1325-1347 |
| AD-414996 | AAAUGUGCAAUAUCUGACUGA | 1034 | 1380-1400 | UCAGUCAGAUAUUGCACAUUUGA | 1128 | 1378-1400 |
| AD-414997 | AAUGUGCAAUAUCUGACUGAA | 1035 | 1381-1401 | UUCAGUCAGAUAUUGCACAUUUG | 1129 | 1379-1401 |
| AD-415000 | AUAUCUGACUGAAAUUAUGGA | 1036 | 1389-1409 | UCCAUAAUUUCAGUCAGAUAUUG | 1130 | 1387-1409 |
| AD-415038 | UUCAAAUGUGCAAUAUCUGAA | 1037 | 1377-1397 | UUCAGAUAUUGCACAUUUGAAAA | 1131 | 1375-1397 |
| AD-415039 | UCAAAUGUGCAAUAUCUGACA | 1038 | 1378-1398 | UGUCAGAUAUUGCACAUUUGAAA | 1132 | 1376-1398 |
| AD-415045 | AAUAUCUGACUGAAAUUAUGA | 1039 | 1388-1408 | UCAUAAUUUCAGUCAGAUAUUGC | 1133 | 1386-1408 |
| AD-415060 | AGCUCUUGCCACAGAACUUGA | 1040 | 1441-1461 | UCAAGUUCUGUGGCAAGAGCUAA | 1134 | 1439-1461 |
| AD-415095 | GCUCUUGCCACAGAACUUGAA | 1041 | 1442-1462 | UUCAAGUUCUGUGGCAAGAGCUA | 1135 | 1440-1462 |
| AD-415621 | CUAGUAGAAAAUAGGCUGCUA | 1042 | 2044-2064 | UAGCAGCCUAUUUUCUACUAGAA | 1136 | 2042-2064 |
| AD-415623 | GAAAAUAGGCUGCUAGGAUGA | 1043 | 2050-2070 | UCAUCCUAGCAGCCUAUUUUCUA | 1137 | 2048-2070 |
| AD-415647 | UAGUAGAAAAUAGGCUGCUAA | 1044 | 2045-2065 | UUAGCAGCCUAUUUUCUACUAGA | 1138 | 2043-2065 |
| AD-415650 | AGAAAAUAGGCUGCUAGGAUA | 1045 | 2049-2069 | UAUCCUAGCAGCCUAUUUUCUAC | 1139 | 2047-2069 |
| AD-415783 | GUAUGAUUUGGGUGGAAAUUA | 1046 | 2268-2288 | UAAUUUCCACCCAAAUCAUACCA | 1140 | 2266-2288 |
| AD-415823 | GGUAUGAUUUGGGUGGAAAUA | 1047 | 2267-2287 | UAUUUCCACCCAAAUCAUACCAC | 1141 | 2265-2287 |
| AD-415913 | UGCACACGUUUUUAUCAGGGA | 1048 | 2456-2476 | UCCCUGAUAAAAACGUGUGCAGA | 1142 | 2454-2476 |
| AD-415914 | GCACACGUUUUUAUCAGGGAA | 1049 | 2457-2477 | UUCCCUGAUAAAAACGUGUGCAG | 1143 | 2455-2477 |
| AD-415915 | CACACGUUUUUAUCAGGGAAA | 1050 | 2458-2478 | UUUCCCUGAUAAAAACGUGUGCA | 1144 | 2456-2478 |
| AD-415962 | UUUUUAUCAGGGAAAGUUUUA | 1051 | 2464-2484 | UAAAACUUUCCCUGAUAAAAACG | 1145 | 2462-2484 |
| AD-415996 | UGGAUGUAGGAUUUAUUGCUA | 1052 | 2483-2503 | UAGCAAUAAAUCCUACAUCCAAA | 1146 | 2481-2503 |
| AD-416175 | AGUAAUUGCAAAGGUUCAGAA | 1053 | 2794-2814 | UUCUGAACCUUUGCAAUUACUGA | 1147 | 2792-2814 |
| AD-416604 | AUGAAAGAUGCCAAUGCUUA | 1054 | 3283-3303 | UAAGCAUUGGCAUCUUUUCAUAC | 1148 | 3281-3303 |
| AD-416632 | GUAUGAAAAGAUGCCAAUGCA | 1055 | 3281-3301 | UGCAUUGGCAUCUUUUCAUACUG | 1149 | 3279-3301 |
| AD-416651 | GCCACAGUAUCCAAAGUGUAA | 1056 | 3309-3329 | UUACACUUUGGAUACUGUGGCUA | 1150 | 3307-3329 |
| AD-417251 | UUUCUUGAUGAAGCCAAAGUA | 1057 | 4025-4045 | UACUUUGGCUUCAUCAAGAAAAA | 1151 | 4023-4045 |
| AD-417255 | AUGAAGCCAAAGUUAAUGAGA | 1058 | 4032-4052 | UCUCAUUAACUUUGGCUUCAUCA | 1152 | 4030-4052 |
| AD-417711 | AUUUAGUCCUAACAAGUGUAA | 1059 | 4511-4531 | UUACACUUGUUAGGACUAAAUUA | 1153 | 4509-4531 |
| AD-417714 | GUCCUAACAAGUGUAGAGCUA | 1060 | 4516-4536 | UAGCUCUACACUUGUUAGGACUA | 1154 | 4514-4536 |
| AD-417736 | AGUCCUAACAAGUGUAGAGCA | 1061 | 4515-4535 | UGCUCUACACUUGUUAGGACUAA | 1155 | 4513-4535 |
| AD-417864 | GUCAUUUUAAGAAUUAGCACA | 1062 | 4781-4801 | UGUGCUAAUUCUUAAAAUGACAG | 1156 | 4779-4801 |
| AD-418067 | AACACUGGACUAAUAGGAAUA | 1063 | 5019-5039 | UAUUCCUAUUAGUCCAGUGUUGU | 1157 | 5017-5039 |
| AD-418094 | CAACACUGGACUAAUAGGAAA | 1064 | 5018-5038 | UUUCCUAUUAGUCCAGUGUUGUA | 1158 | 5016-5038 |
| AD-418096 | ACUGGACUAAUAGGAAUAACA | 1065 | 5022-5042 | UGUUAUUCCUAUUAGUCCAGUGU | 1159 | 5020-5042 |
| AD-418097 | CUGGACUAAUAGGAAUAACUA | 1066 | 5023-5043 | UAGUUAUUCCUAUUAGUCCAGUG | 1160 | 5021-5043 |

TABLE 4B-continued

Mouse ATXN3 unmodified duplex Sequences
Sequences are indicated as "mouse" sequences as they are mapped onto the mouse ATXN3 sequence
NM 029705.3. Duplexes listed in the table may be cross reactive with other species.

| Duplex Name | Unmodified sense sequence | SEQ ID NO | Range (NM_029705.3) | Unmodified antisense sequence | SEQ ID NO | Range (NM_029705.3) |
|---|---|---|---|---|---|---|
| AD-418098 | UGGACUAAUAGGAAUAACUUA | 1067 | 5024-5044 | UAAGUUAUUCCUAUUAGUCCAGU | 1161 | 5022-5044 |
| AD-418100 | GACUAAUAGGAAUAACUUUUA | 1068 | 5026-5046 | UAAAAGUUAUUCCUAUUAGUCCA | 1162 | 5024-5046 |

TABLE 5

ATXN3 Lipid-conjugated Modified Sequences
The C16 modifications shown are exemplary modifications. It is understood other
lipophilic moieties may be used at other locations within the duplex as provided above.

| Duplex Name | Modified sense strand sequence | SEQ ID NO | Modified antisense strand sequence | SEQ ID NO |
|---|---|---|---|---|
| AD-368021 | ususggc(Uhd)CfcAfGfAfcaaauaaascsa | 1163 | VPusGfsuuuAfuUfUfgucuGfgAfgccaascsg | 1393 |
| AD-368023 | gsgscuc(Chd)AfgAfCfAfaauaaacasusa | 1164 | VPusAfsuguUfuAfUfuuguCfuGfgagccsasa | 1394 |
| AD-368024 | gscsucc(Ahd)GfaCfAfAfauaaacausgsa | 1165 | VPusCfsaugUfuUfAfuuugUfcUfggagcscsa | 1395 |
| AD-368025 | csuscca(Ghd)AfcAfAfAfuaaacaugsgsa | 1166 | VPusCfscauGfuUfUfauuuGfuCfuggagscsc | 1396 |
| AD-368027 | cscsaga(Chd)AfaAfUfAfaacauggasgsa | 1167 | VPusCfsuccAfuGfUfuuauUfuGfucuggsasg | 1397 |
| AD-368028 | csasgac(Ahd)AfaUfAfAfacauggagsusa | 1168 | VPusAfscucCfaUfGfuuuaUfuUfgucugsgsa | 1398 |
| AD-368029 | asgsaca(Ahd)AfuAfAfAfcauggaguscsa | 1169 | VPusGfsacuCfcAfUfguuuAfuUfugucusgsg | 1399 |
| AD-368044 | gsasguc(Chd)AfuCfUfUfccacgagasasa | 1170 | VPusUfsucuCfgUfGfgaagAfuGfgacucscsa | 1400 |
| AD-368047 | uscscau(Chd)UfuCfCfAfcgagaaacsasa | 1171 | VPusUfsguuUfcUfCfguggAfaGfauggascsu | 1401 |
| AD-368049 | csasucu(Uhd)CfcAfCfGfagaaacaasgsa | 1172 | VPusCfsuugUfuUfCfucguGfgAfagaugsgsa | 1402 |
| AD-368050 | asuscuu(Chd)CfaCfGfAfgaaacaagsgsa | 1173 | VPusUfscuuGfuUfUfcucgUfgGfaagausgsg | 1403 |
| AD-368052 | csusucc(Ahd)CfgAfGfAfaacaagaasgsa | 1174 | VPusCfsuucUfuGfUfuucuCfgUfggaagsasu | 1404 |
| AD-368053 | ususcca(Chd)GfaGfAfAfacaagaagsgsa | 1175 | VPusCfscuuCfuUfGfuuucUfcGfuggaasgsa | 1405 |
| AD-368055 | cscsacg(Ahd)GfaAfAfCfaagaaggcsusa | 1176 | VPusAfsgccUfuCfUfuguuUfcUfcguggsasa | 1406 |
| AD-368223 | usascag(Chd)AfgCfCfUfucuggaaasusa | 1177 | VPusAfsuuuCfcAfGfaaggCfuGfcuguasasa | 1407 |
| AD-368225 | csasgca(Ghd)CfcUfUfCfuggaaauasusa | 1178 | VPusAfsuauUfuCfCfagaaGfgCfugcugsusa | 1408 |
| AD-368226 | asgscag(Chd)CfuUfCfUfuggaaauausga | 1179 | VPusCfsauaUfuUfCfcagaAfgGfcugcusgsu | 1409 |
| AD-368250 | ususcag(Uhd)GfgUfUfUfaacuugaasusa | 1180 | VPusAfsuucAfaGfUfuaaaCfcAfcugaasusa | 1410 |
| AD-368251 | uscsagu(Ghd)GfuUfUfAfacuugaausua | 1181 | VPusAfsuucCfaAfGfuuaaAfcCfacugasasu | 1411 |
| AD-368252 | csasgug(Ghd)UfuUfAfAfcuugaauuscsa | 1182 | VPusGfsaauUfcAfAfguuaAfaCfcacugsasa | 1412 |
| AD-368253 | asgsugg(Uhd)UfuAfUfAfCfuugaauucsusa | 1183 | VPusAfsgaaUfuCfAfaguuAfaAfccacusgsa | 1413 |
| AD-368337 | asgsgaa(Ghd)GfuUfAfUfucuauauususa | 1184 | VPusAfsaauAfuuAfGfaauaAfcCfuuccsusgsu | 1414 |
| AD-368338 | gsgsaag(Ghd)UfuAfUfUfcuauauuusgsa | 1185 | VPusCfsaaaUfaUfAfgaauAfaCfcuuccsusg | 1415 |
| AD-368339 | gsasagg(Uhd)UfaUfUfCfuauauuugsusa | 1186 | VPusAfscaaUfuAfUfagaaUfaAfccuucscsu | 1416 |
| AD-368427 | asuscga(Chd)CfaAfAfAfcuuauuggsasa | 1187 | VPusUfsccaAfuUfAfguuuUfgGfucgausgsc | 1417 |
| AD-368428 | uscsgac(Chd)AfaAfAfCfuuauuggasgsa | 1188 | VPusCfsuccAfaUfAfaguuUfuGfgucgasusg | 1418 |
| AD-368429 | csgsacc(Ahd)AfaAfCfUfuauuggagsasa | 1189 | VPusUfscucCfaAfUfaaguUfuUfggucgsasu | 1419 |
| AD-368721 | ascscgag(Ahd)AfgCfCfUfacuuugaasasa | 1190 | VPusUfsuucAfaAfGfuaggCfuUfcucguscsu | 1420 |
| AD-368722 | csgsaga(Ahd)GfcCfUfAfcuuugaaasasa | 1191 | VPusUfsuuuCfaAfAfguagGfcUfucucgsusc | 1421 |

ATXN3 Lipid-conjugated Modified Sequences
The C16 modifications shown are exemplary modifications. It is understood other
lipophilic moieties may be used at other locations within the duplex as provided above.

| Duplex Name | Modified sense strand sequence | SEQ ID NO | Modified antisense strand sequence | SEQ ID NO |
|---|---|---|---|---|
| AD-368810 | csusugg(Ghd)AfgUfGfAfucuaggugsasa | 1192 | VPusUfscacCfuAfGfaucaCfuCfccaagsusg | 1422 |
| AD-368811 | ususggg(Ahd)GfuGfAfUfcuaggugasusa | 1193 | VPusAfsucaCfcUfAfgaucAfcUfcccaasgsu | 1423 |
| AD-368814 | gsgsagu(Ghd)AfuCfUfAfggugaugcsusa | 1194 | VPusAfsgcaUfcAfCfcuagAfuCfacuccscsa | 1424 |
| AD-368815 | gsasgug(Ahd)UfcUfAfGfgugaugcusasa | 1195 | VPusUfsagcAfuCfAfccuaGfaUfcacucscsc | 1425 |
| AD-368866 | gsascca(Uhd)GfuCfUfUfuagaaacusgsa | 1196 | VPusCfsaguUfuCfUfaaagAfcAfuggucsasc | 1426 |
| AD-368867 | ascscau(Ghd)UfcUfUfUfagaaacugsusa | 1197 | VPusAfscagUfuUfCfuaaaGfaCfaugguscsa | 1427 |
| AD-368868 | cscsaug(Uhd)CfuUfUfAfgaaacuguscsa | 1198 | VPusGfsacaGfuUfUfcuaaAfgAfcauggsusc | 1428 |
| AD-368869 | csasugu(Chd)UfuUfAfGfaaacugucsasa | 1199 | VPusUfsgacAfgUfUfucuaAfaGfacaugsgsu | 1429 |
| AD-368871 | usgsucu(Uhd)UfaGfAfAfacugucagsasa | 1200 | VPusUfscugAfcAfGfuuucUfaAfagacasusg | 1430 |
| AD-368872 | gsuscuu(Uhd)AfgGfAfAfcugucagasasa | 1201 | VPusUfsucuGfaCfAfguuuCfuAfaagacsasu | 1431 |
| AD-368887 | csasgaa(Ahd)UfgAfUfUfugaaaacasgsa | 1202 | VPusCfsuguUfuUfCfaaauCfaUfuucugsasc | 1432 |
| AD-368891 | asasuga(Uhd)UfuGfAfAfaacagaagsgsa | 1203 | VPusCfscuuCfuGfUfuuucAfaAfucauususc | 1433 |
| AD-368991 | ususuua(Ghd)CfgGfUfUfugcaaacasasa | 1204 | VPusUfsuguUfuGfCfaaacCfgCfuaaaasgsu | 1434 |
| AD-368992 | ususuag(Chd)GfgUfUfUfgcaaacaasasa | 1205 | VPusUfsuugUfuUfGfcaaaCfcGfcuaaasasg | 1435 |
| AD-368993 | ususagc(Ghd)GfuUfUfGfcaaacaaasasa | 1206 | VPusUfsuuuGfuUfUfgcaaAfcCfgcuaasasa | 1436 |
| AD-368994 | usasgcg(Ghd)UfuUfGfCfaaacaaaasusa | 1207 | VPusAfsuuuUfgUfUfugcaAfaCfcgcuasasa | 1437 |
| AD-368995 | asgscgg(Uhd)UfuGfCfAfaacaaaausgsa | 1208 | VPusCfsauuUfuGfUfuugcAfaAfccgcusasa | 1438 |
| AD-368996 | gscsggu(Uhd)UfgCfAfAfacaaaaugsasa | 1209 | VPusUfscauUfuUfGfuuugCfaAfaccgcsusa | 1439 |
| AD-368999 | gsusuug(Chd)AfaAfCfAfaaaugaugsgsa | 1210 | VPusCfscauCfaUfUfuuguUfuGfcaaacscsg | 1440 |
| AD-369000 | ususugc(Ahd)AfaCfAfAfaaugauggsgsa | 1211 | VPusCfsccaUfcAfUfuuugUfuUfgcaaascsc | 1441 |
| AD-369082 | gscsauu(Chd)AfgCfAfAffuuaaagacsasa | 1212 | VPusUfsgucUfuUfAfauugCfuGfaaugcscsu | 1442 |
| AD-369083 | csasuuc(Ahd)GfcAfAfUfuaaagacasusa | 1213 | VPusAfsuguCfuUfUfaauuGfcUfgaaugscsc | 1443 |
| AD-369170 | ususugc(Ahd)GfaCfUfAfgcuaauuasgsa | 1214 | VPusCfsuaaUfuAfGfcuagUfcUfgcaaasasa | 1444 |
| AD-369171 | ususgca(Ghd)AfcUfAfGfcuaauuagscsa | 1215 | VPusGfscuaAfuUfAfgcuaGfuCfugcaasasa | 1445 |
| AD-369172 | usgscag(Ahd)CfuAfGfCfuaauuagcsusa | 1216 | VPusAfsgcuAfaUfUfagcuAfgUfcugcasasa | 1446 |
| AD-369173 | gscsaga(Chd)UfaGfCfUfaauuagcuscsa | 1217 | VPusGfsagcUfaAfUfuagcUfaGfucugcsasa | 1447 |
| AD-369174 | csasgac(Uhd)AfgCfUfAfauuagcucsusa | 1218 | VPusAfsgagCfuAfAfuuagCfuAfgucugscsa | 1448 |
| AD-369314 | gsasugu(Uhd)GfaUfAfAfuaguaaugsgsa | 1219 | VPusCfscauUfaCfUfauuaUfcAfacaucsasg | 1449 |
| AD-369315 | asusguu(Ghd)AfuAfAfUfaguaauggsgsa | 1220 | VPusAfsccaUfuAfCfuauuAfuCfaacauscsa | 1450 |
| AD-369316 | usgsuug(Ahd)UfaAfUfAfguaauggususa | 1221 | VPusAfsaccAfuUfAfcuauUfaUfcaacasusc | 1451 |
| AD-369317 | gsusuga(Uhd)AfaUfAfGfuaaugguuscsa | 1222 | VPusGfsaacCfaUfUfacuaUfuAfucaacsasu | 1452 |
| AD-369318 | ususgau(Ahd)AfuAfGfUfaaugguucsusa | 1223 | VPusAfsgaaCfcAfUfuacuAfuUfaucaascsa | 1453 |
| AD-369319 | usgsaua(Ahd)UfaGfUfAfaugguucuscsa | 1224 | VPusUfsagaAfcCfAffuuacUfaUfuaucasasc | 1454 |
| AD-369409 | ususucu(Ghd)CfuAfCfCfuggguuucsasa | 1225 | VPusUfsgaaAfaCfCfaggUfAfgCfagaaasasg | 1455 |
| AD-369410 | ususcug(Chd)UfaCfCfUfgggguuucasusa | 1226 | VPusAfsugaAfaAfCfcaggUfaGfcagaasasa | 1456 |
| AD-369411 | uscsugc(Uhd)AfcCfUfGfguuuucaususa | 1227 | VPusAfsaugAfaAfAfccagGfuAffgcagasasa | 1457 |

TABLE 5-continued

ATXN3 Lipid-conjugated Modified Sequences
The C16 modifications shown are exemplary modifications. It is understood other
lipophilic moieties may be used at other locations within the duplex as provided above.

| Duplex Name | Modified sense strand sequence | SEQ ID NO | Modified antisense strand sequence | SEQ ID NO |
|---|---|---|---|---|
| AD-369414 | gscsuac(Chd)UfgGfUfUfuucauuaususa | 1228 | VPusAfsauaAfuGfAfaaacCfaGfguagcsasg | 1458 |
| AD-369417 | ascscug(Ghd)UfuUfUfCfauuauuuuscsa | 1229 | VPusGfsaaaAfuAfAfugaaAfaCfcaggusasg | 1459 |
| AD-369418 | cscsugg(Uhd)UfuUfCfAfuuauuuucscsa | 1230 | VPusGfsgaaAfaUfAfaugaAfaAfccaggsusa | 1460 |
| AD-369419 | csusggu(Uhd)UfuCfAfUfuauuuuccscsa | 1231 | VPusGfsggaAfaAfUfaaugAfaAfaccagsgsu | 1461 |
| AD-369420 | usgsguu(Uhd)UfcAfUfUfauuuucccsasa | 1232 | VPusUfsgggAfaAfAfuaauGfaAfaaccasgsg | 1462 |
| AD-369421 | gsgsuuu(Uhd)CfaUfUfAfuuuucccsascsa | 1233 | VPusGfsuggGfaAfAfauaaUfgAfaaaccsasg | 1463 |
| AD-369423 | ususuuc(Ahd)UfuAfUfUfuucccacasasa | 1234 | VPusUfsuguGffgGfAfaaauAfaUfgaaaascsc | 1464 |
| AD-369424 | ususuca(Uhd)UfaUfUfUfucccacaasusa | 1235 | VPusAfsuugUfgGfGfaaaaUfaAfugaaasasc | 1465 |
| AD-369426 | uscsauu(Ahd)UfuUfUfCfccacaauuscsa | 1236 | VPusGfsaauUfgUfGfggaaAfaUfaaugasasa | 1466 |
| AD-369428 | asusuau(Uhd)UfuCfCfCfacaauucususa | 1237 | VPusAfsagaAfuUfGfugggAfaAfauaausgsa | 1467 |
| AD-369429 | ususauu(Uhd)UfcCfCfAfcaauucuususa | 1238 | VPusAfsaagAfaUfUfguggGfaAfaauaasusg | 1468 |
| AD-369430 | usasuuu(Uhd)CfcCfAfCfaauucuuususa | 1239 | VPusAfsaaaGfaAfUfugugGffgAfaaauasasu | 1469 |
| AD-369431 | asusuuu(Chd)CfcAfCfAfauucuuuusgsa | 1240 | VPusCfsaaaAfgAfAfuguGfgGfaaaausasa | 1470 |
| AD-369432 | ususuuc(Chd)CfaCfAfAfuucuuuugsasa | 1241 | VPusUfscaaAfaGfAfauugUfgGfgaaaasusa | 1471 |
| AD-369433 | ususucc(Chd)AfcAfAfUfucuuuugasasa | 1242 | VPusUfsucaAfaAfGfaauuGfuGfggaaasasu | 1472 |
| AD-369434 | ususccc(Ahd)CfaAfUfUfcuuuugaasasa | 1243 | VPusUfsuucAfaAfAfgaauUfgUfgggaasasa | 1473 |
| AD-369435 | uscscca(Chd)AfaUfUfCfuuuugaaasgsa | 1244 | VPusCfsuuuCfaAfAfagaaUfuGfugggasasa | 1474 |
| AD-369437 | cscsaca(Ahd)UfuCfUfUfuugaaagasusa | 1245 | VPusAfsucuUfuCfAfaaagAfaUfguggsgsa | 1475 |
| AD-369445 | csusuuu(Ghd)AfaAfGfAfugguaaucsusa | 1246 | VPusAfsgauUfaCfCfaucuUfuCfaaaagsasa | 1476 |
| AD-369446 | ususuug(Ahd)AfaGfAfUfgguaaucususa | 1247 | VPusAfsagaUfuAfCfcaucUfuUfcaaaasgsa | 1477 |
| AD-369447 | ususuga(Ahd)AfgAfUfGfguaaucuususa | 1248 | VPusAfsaagAfuUfAfccauCfuUfucaaasasg | 1478 |
| AD-369448 | ususgaa(Ahd)GfaUfGfGfuaaucuuususa | 1249 | VPusAfsaaaGfaUfUfaccaUfcUfuucaasasa | 1479 |
| AD-369449 | usgsaaa(Ghd)AfuGfGfUfaaucuuuuscsa | 1250 | VPusGfsaaaAfgAfUfuaccAffuCfuuucasasa | 1480 |
| AD-369450 | gsasaag(Ahd)UfgGfUfAfaucuuuucsusa | 1251 | VPusAfsgaaAfaGfAfuuacCfaUfcuuucsasa | 1481 |
| AD-369451 | asasaga(Uhd)GfgUfAfAfucuuuucusgsa | 1252 | VPusCfsagaAfaAfGfauuaCfcAfucuuuscsa | 1482 |
| AD-369513 | gsasucug(Ghd)UfgCfGfUfuccuaaacsusa | 1253 | VPusAfsguuUfaGfGfaacgCfaCfcagucsasu | 1483 |
| AD-369515 | csusggu(Ghd)CfgUfUfCfcuaaacucsusa | 1254 | VPusAfsgagUfuUfAfggaaCfgCfaccagsusc | 1484 |
| AD-369516 | usgsgug(Chd)GfuUfCfCfuaaacucusgsa | 1255 | VPusCfsagaGfuUfUfaggaAfcGfcaccasgsu | 1485 |
| AD-369517 | gsgsugc(Chd)UfuCfCfUfaaacucugsasa | 1256 | VPusUfscagAfgUfUfuaggAfaCfgcaccsasg | 1486 |
| AD-369518 | gsusgcg(Uhd)UfcCfUfAfaacucugasasa | 1257 | VPusUfsucaGfaGfUfuuagGfaAfcgcacscsa | 1487 |
| AD-369519 | usgsgcgu(Uhd)CfcUfAfAfacucugaasasa | 1258 | VPusUfsuucAfgAfGfuuuaGfgAfacgcascsc | 1488 |
| AD-369559 | ususuaa(Ahd)AfuGfUfGfugagcaugsusa | 1259 | VPusAfscauGfcUfCfacacAffuUfuuaaasasa | 1489 |
| AD-369560 | ususaaa(Ahd)UfgUfGfUfgagcaugusgsa | 1260 | VPusCfsacaUfgCfUfcacaCfaUfuuuaasasa | 1490 |
| AD-369568 | usgsuga(Ahd)CfaUfGfUfgcuuucccsusa | 1261 | VPusUfsgggAfaAfGfcacaUfgCfucacascsa | 1491 |
| AD-369569 | gsusgag(Chd)AfuGfUfGfcuuucccasgsa | 1262 | VPusCfsuggGfaAfAfgcacAfuGfcucacsasc | 1492 |
| AD-369571 | gsasgca(Uhd)GfuGfCfUfuucccagasusa | 1263 | VPusAfsucuGfgGfAfaagcAfcAfugcucsasc | 1493 |
| AD-369572 | asgscau(Ghd)UfgCfUfUfucccagausgsa | 1264 | VPusCfsaucUfgGfGfaaagCfaCffaugcuscsca | 1494 |

TABLE 5-continued

ATXN3 Lipid-conjugated Modified Sequences
The C16 modifications shown are exemplary modifications. It is understood other
lipophilic moieties may be used at other locations within the duplex as provided above.

| Duplex Name | Modified sense strand sequence | SEQ ID NO | Modified antisense strand sequence | SEQ ID NO |
|---|---|---|---|---|
| AD-369574 | csasugu(Ghd)CfuUfUfCfccagaugcsusa | 1265 | VPusAfsgcaUfcUfGfggaaAfgCfacaugscsu | 1495 |
| AD-369575 | asusgug(Chd)UfuUfCfCfcagaugcususa | 1266 | VPusAfsagcAfuCfUfgggaAfaGfcacausgsc | 1496 |
| AD-369576 | usgsugc(Uhd)UfuCfCfCfagaugcuususa | 1267 | VPusAfsaagCfaUfCfugggAfaAfgcacasusg | 1497 |
| AD-369579 | gscsuuu(Chd)CfcAfGfAfugcuuuausgsa | 1268 | VPusCfsauaAfaGfCfaucuGfgGfaaaagcsasc | 1498 |
| AD-369580 | csusuuc(Chd)CfaGfAfUfgcuuuaugsasa | 1269 | VPusUfscauAfaAfGfcaucUfgGfgaaagscsa | 1499 |
| AD-369581 | ususucc(Chd)AfgAfUfGfcuuuaugasasa | 1270 | VPusUfsucaUfaAfAfgcauCfuGfgggaaasgsc | 1500 |
| AD-369582 | ususccc(Ahd)GfaUfGfCfuuuaugaasusa | 1271 | VPusAfsuucAfuAfAfagcaUfcUfgggaasasg | 1501 |
| AD-369606 | ususuca(Chd)UfaUfUfAfucaaaaccsusa | 1272 | VPusAfsgguUfuUfGfauauAfaGfugaaasasg | 1502 |
| AD-369609 | csascuu(Ahd)UfaUfCfAfaaaccuuascsa | 1273 | VPusGfsuaaGfgUfUfuugaUfaUfaagugsasa | 1503 |
| AD-369611 | csusuau(Ahd)UfcAfAfAfaccuuacasgsa | 1274 | VPusCfsuguAfaGfGfuuuuGfaUfauaagsusg | 1504 |
| AD-369612 | ususaua(Uhd)CfaAfAfAfccuuacagscsa | 1275 | VPusGfscugUfaAfGfguuuUfgAfuauaasgsu | 1505 |
| AD-369614 | asusauc(Ahd)AfaAfCfCfuuacagcususa | 1276 | VPusAfsagcUfgUfAfagguUfuUfgauausasa | 1506 |
| AD-369616 | asuscaa(Ahd)AfcCfUfUfacagcuuusgsa | 1277 | VPusCfsaaaGfcUfGfuaagGfuUfuugausasu | 1507 |
| AD-369617 | uscsaaa(Ahd)CfcUfUfAfcagcuuugsusa | 1278 | VPusAfscaaAfgCfUfguaaGfgUfuuugasusa | 1508 |
| AD-369618 | csasaaa(Chd)CfuUfAfCfagcuuugususa | 1279 | VPusAfsacaAfaGfCfuguaAfgGfuuuugsasu | 1509 |
| AD-369619 | asasaac(Chd)UfuAfCfAfgcuuuguusgsa | 1280 | VPusCfsaacAfaAfGfcuguAfaGfguuuusgsa | 1510 |
| AD-369620 | asasacc(Uhd)UfaCfAfAfgcuuuguugscsa | 1281 | VPusGfscaaCfaAfAfgcugUfaAfgguuususg | 1511 |
| AD-369621 | asasccu(Uhd)AfcAfGfCfuuuguugcsasa | 1282 | VPusUfsgcaAfcAfAfagcuGfuAfagguususu | 1512 |
| AD-369622 | ascscuu(Ahd)CfaGfCfUfuuguugcasasa | 1283 | VPusUfsugcAfaCfAfaagcUfgUfaaggususu | 1513 |
| AD-369623 | cscsuua(Chd)AfgCfUfUfuguugcaascsa | 1284 | VPusGfsuugCfaAfCfaaagCfuGfuaaggsusu | 1514 |
| AD-369624 | csusuac(Ahd)GfcUfUfUfguugcaacscsa | 1285 | VPusGfsguuGfcAfAfcaaaGfcUfguaagsgsu | 1515 |
| AD-369625 | csusucu(Uhd)CfcUfGfCfgccuuauususa | 1286 | VPusAfsaauAfaGfGfcgcaGfgAfagaagsgsg | 1516 |
| AD-369626 | ususcuu(Chd)CfuGfCfGfccuuauuususa | 1287 | VPusAfsaaaUfaAfGfgcgcAfgGfaagaasgsg | 1517 |
| AD-369630 | cscsuuu(Chd)UfuCfUfCfcaauugagsasa | 1288 | VPusUfscucAfaUfUfggagAfaGfaaaggsasa | 1518 |
| AD-369631 | csusuuc(Uhd)UfcUfCfCfaauugagasasa | 1289 | VPusUfsucuCfaAfUfuggaGfaAfgaaagsgsa | 1519 |
| AD-369632 | ususucu(Uhd)CfuCfCfAfauugagaasasa | 1290 | VPusUfsuucUfcAfAfuuggAfgAfagaaasgsg | 1520 |
| AD-369633 | ususcuu(Chd)UfcCfAfAfuugagaaasasa | 1291 | VPusUfsuuuCfuCfAfauugGfaGfaagaasasg | 1521 |
| AD-388251 | csasgug(Ghd)UfuUfAfAfcuugaauuscsa | 1292 | VPusGfsaauUfcAfAfguuaAfaCfcacugscsu | 1522 |
| AD-388252 | asgsugg(Uhd)UfuAfAfCfuugaauucsusa | 1293 | VPusAfsgaaUfuCfAfaguuAfaAfccacusgsc | 1523 |
| AD-413817 | gsasguc(Chd)AfuCfUfUfccacgagasasa | 1294 | VPusUfsucuCfgUfGfgaagAfuUfgacucscsa | 1524 |
| AD-414319 | csasaca(Ghd)AfuGfCfAfucgaccaasasa | 1295 | VPusUfsuugGfucCfGfaugcAfuCfuguugsgsa | 1525 |
| AD-414320 | asgsaug(Chd)AfuCffGfAfccaaaacususa | 1296 | VPusAfsaguUfuUfGfgucgAfuGfcaucusgsu | 1526 |
| AD-414322 | uscsgac(Chd)AfaAfAfCfuuauuggasgsa | 1297 | VPusCfsuccAfaUfAfaguuUfuGfgucgasusg | 1527 |
| AD-414534 | gsusaug(Chd)AfaGfGfUfaguuccagsasa | 1298 | VPusUfscugGfaAfCfuaccUfuGfcauacsusg | 1528 |
| AD-388257 | asgscag(Uhd)GfgUfUfUfaacuugaasusa | 1299 | VPusAfsuucAfaGfUfuaaaCfcAfcugcususg | 1529 |
| AD-388258 | gscsagu(Ghd)GfuUfUfAfacuugaaususa | 1300 | VPusAfsauuCfaAfGfuuaaAfcCfacugcsusu | 1530 |

TABLE 5-continued

ATXN3 Lipid-conjugated Modified Sequences
The C16 modifications shown are exemplary modifications. It is understood other
lipophilic moieties may be used at other locations within the duplex as provided above.

| Duplex Name | Modified sense strand sequence | SEQ ID NO | Modified antisense strand sequence | SEQ ID NO |
|---|---|---|---|---|
| AD-388330 | asasgaa(Ghd)GfuUfAfUfucuauauususa | 1301 | VPusAfsaauAfuAfGfaauaAfcCfuucuusgsc | 1531 |
| AD-388331 | asgsaag(Ghd)UfuAfUfUfcuauauuusgsa | 1302 | VPusCfsaaaUfaUfAfgaauAfaCfcuucususg | 1532 |
| AD-388403 | csgsacc(Ahd)AfaAfCfUfuauuggagsasa | 1303 | VPusUfscucCfaAfUfaaguUfuUfggucgsasu | 1533 |
| AD-388693 | csgsaga(Ahd)GfcCfUfAfcuuugaaasasa | 1304 | VPusUfsuuuCfaAfAfguagGfcUfucucgsusc | 1534 |
| AD-413834 | gsgscuc(Chd)AfgAfCfAfaauaaacasusa | 1305 | VPusAfsuguUfuAfUfuuguCfuGfgagccsasa | 1535 |
| AD-413843 | asasuaa(Ahd)CfaUfGfGfaguccaucsusa | 1306 | VPusAfsgauGfgAfCfuccaUfgUfuuauususg | 1536 |
| AD-413849 | asgsucc(Ahd)UfcUfUfCfcacgagaasasa | 1307 | VPusUfsuucUfcGfUfggaaGfaUfggacuscsc | 1537 |
| AD-413912 | usgscaa(Ghd)GfaGfAfGfuauuuuagscsa | 1308 | VPusGfscuaAfaAfUfacucUfcCfuugcasasu | 1538 |
| AD-413913 | gscsaag(Ghd)AfgAfGfUfauuuuagcscsa | 1309 | VPusGfsgcuAfaAfAfuacuCfuCfcuugcsasa | 1539 |
| AD-413959 | gsasaga(Chd)UfaCfCfGfcacauuuususa | 1310 | VPusAfsaaaAfuGfUfgcggUfaGfucuucsasc | 1540 |
| AD-413960 | asgsacu(Ahd)CfcGfCfAfcauuuuuascsa | 1311 | VPusGfsuaaAfaAfUfgugcGfgUfagucususc | 1541 |
| AD-413961 | csusacc(Ghd)CfaCfAfUfuuuuacagscsa | 1312 | VPusGfscugUfaAfAfaaugUfgCfgguagsusc | 1542 |
| AD-413986 | gsusgaa(Ghd)AfcUfAfCfcgcacauususa | 1313 | VPusAfsaauGfuGfCfgguaGfuUfcuucacsusa | 1543 |
| AD-413987 | usgsaag(Ahd)CfuAfCfCfgcacauususa | 1314 | VPusAfsaaaUfgUfGfcgguAfgUfcuucascsu | 1544 |
| AD-413988 | asasgac(Uhd)AfcCfGfCfacauuuuusasa | 1315 | VPusUfsaaaAfaUfGfugcgGfuAfgucuuscsa | 1545 |
| AD-413990 | ascsuac(Chd)GfcAfCfAfuuuuuacasgsa | 1316 | VPusCfsuguAfaAfAfauguGfcGfguaguscsu | 1546 |
| AD-413991 | usasccg(Chd)AfcAfUfUfuuuacagcsasa | 1317 | VPusUfsgcuGfuAfAfaaauGfuGfcgguasgsu | 1547 |
| AD-413993 | cscsgca(Chd)AfuUfUfUfuacagcagscsa | 1318 | VPusGfscugCfuGfUfaaaaAfuGfugcggsusa | 1548 |
| AD-414002 | csasgca(Ghd)CfcUfUfCfuggaaauasusa | 1319 | VPusAfsuauUfuCfCfagaaGfgCfugcugsusa | 1549 |
| AD-414020 | csasgcg(Ghd)CfuUfUfUfucucuauuscsa | 1320 | VPusGfsaauAfgAfGfaaaaAfgCfcgcugsusc | 1550 |
| AD-414025 | uscsucu(Ahd)UfuCfAfAfguuauaagscsa | 1321 | VPusGfscuuAfuAfAfcuugAfaUfagagasasa | 1551 |
| AD-414026 | csuscua(Uhd)UfcAfAfGfuuauaagcsasa | 1322 | VPusUfsgcuUfaUfAfacuuGfaAfuagagsasa | 1552 |
| AD-414044 | usgsaca(Ghd)CfgGfCfUfuuuucucusasa | 1323 | VPusUfsagaGfaAfAfaagcCfgCfugucasusc | 1553 |
| AD-414047 | gscsggc(Uhd)UfuUfUfCfucuauucasasa | 1324 | VPusUfsugaAfuAfGfagaaAfaAfgccgcsusg | 1554 |
| AD-414055 | usasuuc(Ahd)AfgUfUfAfuaagcaausgsa | 1325 | VPusCfsauuGfcUfUfauaaCfuUfgaauasgsa | 1555 |
| AD-414104 | asasgau(Chd)CfuUfUfAfuaugcaaususa | 1326 | VPusAfsauUfgcAfUfauaaAffgGfaucuususc | 1556 |
| AD-414112 | asascac(Uhd)GfgUfUfUfacaguuagsasa | 1327 | VPusUfscuaAfcUfGfuaaaCfcAffguguuscsu | 1557 |
| AD-414113 | ascsacu(Ghd)GfuUfUfAfcaguuagasasa | 1328 | VPusUfsucuAfaCfUfguaaAfcCfagugusuc | 1558 |
| AD-414139 | asasaga(Uhd)CfcUfUfUfauaugcaasusa | 1329 | VPusAfsuugCfaUfAfuaaaGfgAfucuuuscsg | 1559 |
| AD-414146 | csasauu(Ahd)UfaAfAfGfaacacuggsusa | 1330 | VPusAfsccaGfuGfUfucuuUfaUfaauugscsa | 1560 |
| AD-414151 | asasaga(Ahd)CfaCfUfGfguuuacagsusa | 1331 | VPusAfscugUfaAfAfccagUfgUfucuuusasu | 1561 |
| AD-414152 | asgsaac(Ahd)CfuGfGfUfuuacaguusa | 1332 | VPusUfsaacUfgUfAfaaccAffgUfguucususu | 1562 |
| AD-414171 | asgscag(Uhd)GfgUfUfUfaacuugaasusa | 1333 | VPusAfsuucAfaGfUfuaaaCfcAfcugcuusg | 1563 |
| AD-414245 | usascag(Chd)AfaGfAfAfgguuauucsusa | 1334 | VPusAfsgaaUfaAfCfcuucUfuGfcguasasu | 1564 |
| AD-414262 | asasuua(Chd)AfgCfAfAfgaagguuasusa | 1335 | VPusAfsuaaCfcUfUfcuugCfuGfuaauusgsa | 1565 |
| AD-414263 | asusuac(Ahd)GfcAfAfGfaagguuausa | 1336 | VPusAfsauaAfcCfUfucuuGfcUfguaausug | 1566 |
| AD-414265 | ascsagc(Ahd)AfgAfAfAfgguuauucsasa | 1337 | VPusUfsagaAfuAfAfccuuCfuUfgcugusasa | 1567 |

TABLE 5-continued

ATXN3 Lipid-conjugated Modified Sequences
The C16 modifications shown are exemplary modifications. It is understood other
lipophilic moieties may be used at other locations within the duplex as provided above.

| Duplex Name | Modified sense strand sequence | SEQ ID NO | Modified antisense strand sequence | SEQ ID NO |
|---|---|---|---|---|
| AD-414266 | asgscaa(Ghd)AfaGfGfUfuauucuausasa | 1338 | VPusUfsauaGfaAfUfaaccUfuCfuugcusgsu | 1568 |
| AD-414267 | gscsaag(Ahd)AfgGfUfUfauucuauasusa | 1339 | VPusAfsuauAfgGfAfuaacCfuUfcuugcsusg | 1569 |
| AD-414268 | csasaga(Ahd)GfgUfUfAfuucuauaususa | 1340 | VPusAfsauaUfaGfAfauaaCfcUfucuugscsu | 1570 |
| AD-414288 | asasggg(Uhd)GfaUfCfUfgccagauusgsa | 1341 | VPusCfsaauCfuGfGfcagaUfcAfcccuusasa | 1571 |
| AD-414300 | ususgug(Ahd)AfgCfUfGfaccaacuususa | 1342 | VPusAfsaagUfuGfGfucagCfuUfcacaasusc | 1572 |
| AD-414301 | usgsuga(Ahd)GfcUfGfAfccaacuususa | 1343 | VPusAfsaaaGfuUfGfgucaGfcUfucacasasu | 1573 |
| AD-414343 | csasgau(Ghd)AfuCfAfAfgguccaacsasa | 1344 | VPusUfsguuGfgAfCfcuugAfuCfaucugscsa | 1574 |
| AD-414344 | gsasuga(Uhd)CfaAfGfGfuccaacagsasa | 1345 | VPusUfscugUfuGfGfaccuUfgAfucaucsusg | 1575 |
| AD-414345 | asusgau(Chd)AfaGfGfUfccaacagasusa | 1346 | VPusAfsucuGfuUfGfgaccUfuGfaucauscsu | 1576 |
| AD-414353 | ascsaga(Uhd)GfcAfUfCfgaccaaaascsa | 1347 | VPusGfsuuuUfgGfUfcgauGfcAfucugususg | 1577 |
| AD-414354 | csasgau(Ghd)CfaUfCfGfaccaaaacsusa | 1348 | VPusAfsguuUfuGfGfucgaUfgCfaucugsusu | 1578 |
| AD-414355 | gsasugc(Ahd)UfcGfAfCfcaaaacuusasa | 1349 | VPusUfsaagUfuUfUfgggucGfaUfgcaucsusg | 1579 |
| AD-414356 | asusgca(Uhd)CfgAfCfCfaaaacuuasusa | 1350 | VPusAfsuaaGfuUfUfugguCfgAfugcauscsu | 1580 |
| AD-414359 | asuscga(Chd)CfaAfAfAfcuuauuggsasa | 1351 | VPusUfsccaAfuAfAfguuuUfgGfucgausgsc | 1581 |
| AD-414563 | uscsagc(Uhd)CfaGfUfAfugcaaggusasa | 1352 | VPusUfsaccUfuGfCfauacUfgAfgcugasasu | 1582 |
| AD-414564 | csasgcu(Chd)AfgUfAfUfgcaaggusasgsa | 1353 | VPusCfsuacCfuUfGfcauaCfuUfgagcugsasa | 1583 |
| AD-414566 | gscsuca(Ghd)UfaUfGfCfaagguagususa | 1354 | VPusAfsacuAfcCfUfugcaUfaCfugagcsusg | 1584 |
| AD-414619 | csusacu(Uhd)UfgAfAfAfagcaacagscsa | 1355 | VPusGfscugUfuGfCfuuuuCfaAfaguagsgsc | 1585 |
| AD-414943 | asgsugg(Uhd)UfuGfUfAfagcagaaasgsa | 1356 | VPusCfsuuuCfuGfCfuuacAfaAfccacusasc | 1586 |
| AD-414983 | asasgag(Ghd)CfaGfUfCfagcaaugasasa | 1357 | VPusUfssucaUfuGfCfugacUfgCfcucuususg | 1587 |
| AD-414996 | asasaug(Uhd)GfcAfAfUfaucugacusgsa | 1358 | VPusCfsaguCfaGfAfuauuGfcAfcauuusgsa | 1588 |
| AD-414997 | asasugu(Ghd)CfaAfUfAfucugacugsasa | 1359 | VPusUfscagUfcAfGfauauUfgCfacauusgsg | 1589 |
| AD-415000 | asusauc(Uhd)GfaCfUfGfaaauuaugsgsa | 1360 | VPusCfscauAfaUfUfucagUfcAfgauausgsg | 1590 |
| AD-415038 | ususcaa(Ahd)UfgUfGfCfaauaucugsasa | 1361 | VPusUfscagAfuAfUfugcaCfaUfuugaasasa | 1591 |
| AD-415039 | uscsaaa(Uhd)GfuGfCfAfauauaucugascsa | 1362 | VPusGfsucaGfaUfAfuugcAfcaUfuugasasa | 1592 |
| AD-415045 | asasuau(Chd)UfgAfCfUfgaaauuausgsa | 1363 | VPusCfsauaAfuUfUfcaguCfaGfauauusgsc | 1593 |
| AD-415060 | asgscuc(Uhd)UfgCfCfAfcagaacuusgsa | 1364 | VPusCfsaagUfuCfUfguggCfaAfgagcusasa | 1594 |
| AD-415095 | gscsucu(Uhd)GfcCfAfCfagaacuugsasa | 1365 | VPusUfscaaGfuUfCfugugGfcAfagagcsusa | 1595 |
| AD-415621 | csusagu(Ahd)GfaAfAfAfuaggcugcsusa | 1366 | VPusAfsgcaGfcCfUfauuuUfcUfacuagsasa | 1596 |
| AD-415623 | gsasaaa(Uhd)AfgGfCfUfgcuaggausgsa | 1367 | VPusCfsaucCfuAfGfcagcCfuAfuuuucsusa | 1597 |
| AD-415647 | usasgua(Ghd)AfaAfAfUfaggcugcusgsa | 1368 | VPusUfsagcAffgCfCfuauuUfuCfuacuasgsa | 1598 |
| AD-415650 | asgsaaa(Ahd)UfaGfGfCfugcuaggasusa | 1369 | VPusAfssuccUfaGfCfagccUfaUfuuucusasc | 1599 |
| AD-415783 | gsusaug(Ahd)UfuUfGfGfguggaaausasa | 1370 | VPusAfssauuUfcCfAfcccaAfaUfcauacscsa | 1600 |
| AD-415823 | gsgsuau(Ghd)AfuUfUfGfgguggaaasusa | 1371 | VPusAfsuuuCfcAfCffccaaAfuCfauaccsasc | 1601 |
| AD-415913 | usgscac(Ahd)CfgUfUfUfuuaucaggsgsa | 1372 | VPusCfsccuGfaUfAfaaaaCfgUfgugcasgsa | 1602 |
| AD-415914 | gscsaca(Chd)GfuUfUfUfuauucagggsasa | 1373 | VPusUfscccUfgaAfUfaaaaAfcGfgugucsasg | 1603 |

TABLE 5-continued

ATXN3 Lipid-conjugated Modified Sequences
The C16 modifications shown are exemplary modifications. It is understood other
lipophilic moieties may be used at other locations within the duplex as provided above.

| Duplex Name | Modified sense strand sequence | SEQ ID NO | Modified antisense strand sequence | SEQ ID NO |
|---|---|---|---|---|
| AD-415915 | csascac(Ghd)UfuUfUfUfaucagggasasa | 1374 | VPusUfsuccCfuGfAfuaaaAfaCfgugugscsa | 1604 |
| AD-415962 | ususuuu(Ahd)UfcAfGfGfgaaaaguuususa | 1375 | VPusAfsaaaCfuUfUfcccuGfaUfaaaaascsg | 1605 |
| AD-415996 | usgsgau(Ghd)UfaGfGfAfuuuuauugcsusa | 1376 | VPusAfsgcaAfuAfAfauccUfaCfauccasasa | 1606 |
| AD-416175 | asgsuaa(Uhd)UfgCfAfAfagguucagsasa | 1377 | VPusUfscugAfaCfCfuuugCfaAfuuacusgsa | 1607 |
| AD-416604 | asusgaa(Ahd)AfgAfUfGfccaaugcususa | 1378 | VPusAfsagcAfuUfGfgcauCfuUfuucausasc | 1608 |
| AD-416632 | gsusaug(Ahd)AfaAfGfAfugccaaugscsa | 1379 | VPusGfscauUfgGfCfaucuUfuUfcauacsusg | 1609 |
| AD-416651 | gscscac(Ahd)GfuAfUfCfcaaagugusasa | 1380 | VPusUfsacaCfuUfUfggauAfcUfguggcsusa | 1610 |
| AD-417251 | ususucu(Uhd)GfaUfGfAfagccaaagsusa | 1381 | VPusAfscuuUfgGfCfuucaUfcAfagaaasasa | 1611 |
| AD-417255 | asusgaa(Ghd)CfcAfAfAfguuaaugasgsa | 1382 | VPusCfsucaUfuAfAfcuuuGfgCfuucauscsa | 1612 |
| AD-417711 | asusuua(Ghd)UfcCfUfAfacaagugusasa | 1383 | VPusUfsacaCfuUfGfuuagGfaCfuaaaususa | 1613 |
| AD-417714 | gsusccu(Ahd)AfcAfAfGfuguagagcsusa | 1384 | VPusAfsgcuCfuAfCfacuuGfuUfaggacsusa | 1614 |
| AD-417736 | asgsucc(Uhd)AfaCfAfAfguguagagscsa | 1385 | VPusGfscucUfaCfAfcuugUfuAfggacusasa | 1615 |
| AD-417864 | gsuscau(Uhd)UfuAfAfGfaauuagcascsa | 1386 | VPusGfsugcUfaAfUfucuuAfaAfaugacsasg | 1616 |
| AD-418067 | asascac(Uhd)GfgAfCfUfaauaggaasusa | 1387 | VPusAfsuucCfuAfUfuaguCfcAfguguusgsu | 1617 |
| AD-418094 | csasaca(Chd)UfgGfAfCfuaauaggasasa | 1388 | VPusUfsuccUfaUfUfagucCfaGfuguugsusa | 1618 |
| AD-418096 | ascsugg(Ahd)CfuAfAfUfaggaauaascsa | 1389 | VPusGfsuuaUfuCfCfuauuAfgUfccagusgsu | 1619 |
| AD-418097 | csusgga(Chd)UfaAfUfAfggaauaacsusa | 1390 | VPusAfsguuAfuUfCfcuauUfaGfuccagsusg | 1620 |
| AD-418098 | usgsgac(Uhd)AfaUfAfGfgaauaacususa | 1391 | VPusAfsaguUfaUfUfccuaUfuAfguccasgsu | 1621 |
| AD-418100 | gsascua(Ahd)UfaGfGfAfauaacuuususa | 1392 | VPusAfsaaaGfuUfAfuuccUfaUfuagucscsa | 1622 |

Example 2. In Vivo Evaluation of RNAi Agents

Selected ATXN3-targeting RNAi agents were evaluated for in vivo efficacy and lead identification screens for human ATXN3 knockdown in AAV mice. The selected RNAi agents for such studies included AD-368047, AD-368049, AD-368050, AD-368225, AD-368337, AD-368427, AD-368721, AD-368869, AD-368991, AD-368996, AD-369082, AD-414322, AD-368815, AD-368871, having chemically modified sequences and L96 GalNAc ligands as recited in Table 2 above, corresponding unmodified sequences as shown in Table 4A above (summarized in Table 11 and FIG. 3A-FIG. 3B). Similarly, AD-1103843.2,_AD-1069823.2, AD-414356.2, AD-1069828.2, AD-1069829.2, AD-1069830.2, AD-1041266.2, AD-368995.2, AD-368996.2 were also tested (summarized in Table 10 and FIG. 1).

TABLE 10

ATXN3 in vivo single-dose screen with one set of exemplary ATXN3
siRNA duplexes. In this table the column "Duplex Name" provides the numerical part
of the duplex name. The duplex name can comprise a suffix (number foUowing the
decimal point in a duplex name) that merely refers to a batch production number. The
suffix can be omitted from the duplex name without changing the chemical structure.
For example, duplex AD-1069830.1 in Table 7A refers to the same duplex as AD-1069830
in Table 10.

| Duplex Name | Strand | Modified Sequences (5'-3') | SEQ ID NO (modified) | Unmodified Sequences (5'-3') | SEQ ID NO (unmodified) |
|---|---|---|---|---|---|
| AD-368995 | sense | asgscgguUfuGfCfAfaac aaaaugaL96 | 58 | AGCGGUUUGCAAA CAAAAUGA | 748 |
|  | anti-sense | usCfsauuu(Tgn)guuugc AfaAfccgcusasa | 288 | UCAUUUGUUUGC AAACCGCUAA | 884 |

TABLE 10-continued

ATXN3 in vivo single-dose screen with one set of exemplary ATXN3
siRNA duplexes. In this table the column "Duplex Name" provides the numerical part
of the duplex name. The duplex name can comprise a suffix (number foUowing the
decimal point in a duplex name) that merely refers to a batch production number. The
suffix can be omitted from the duplex name without changing the chemical structure.
For example, duplex AD-1069830.1 in Table 7A refers to the same duplex as AD-1069830
in Table 10.

| Duplex Name | Strand | Modified Sequences (5'-3') | SEQ ID NO (modified) | Unmodified Sequences (5'-3') | SEQ ID NO (unmodified) |
|---|---|---|---|---|---|
| AD-368996 | sense | gscsgguuUfgCfAfAfaca aaaugauL96 | 59 | GCGGUUUGCAAAC AAAAUGAU | 749 |
| | anti-sense | asUfscauu(Tgn)uguuu gCfaAfaccgcsusa | 289 | AUCAUUUGUUUG CAAACCGCUA | 885 |
| AD-1041266 | sense | gsasggcaUfuCfAfGfcaa uuaaagaL96 | 1629 | GAGGCAUUCAGCA AUUAAAGA | 1806 |
| | anti-sense | VPusCfsuuuAfaUfUfgc ugAfaUfgccucsusu | 1688 | UCUUUAAUUGCUG AAUGCCUCUU | 1865 |
| AD-414356 | sense | asusgcauCfgAfCfCfaaa acuuauaL96 | 199 | AUGCAUCGACCAA AACUUAUA | 1026 |
| | anti-sense | VPusAfsuaaGfuUfUfug guCfgAfugcauscsu | 429 | UAUAAGUUUUGG UCGAUGCAUCU | 1120 |
| AD-1103843 | sense | gsasgugaUfcUfAfGfgu gaugcuaaL96 | 1675 | GAGUGAUCUAGGU GAUGCUAA | 1852 |
| | anti-sense | VPusUfsagca(Tgn)cacc uaGfaUfcacucscsc | 1734 | UUAGCATCACCUA GAUCACUCCC | 1911 |
| AD-1069823 | sense | asgsgaa(Ghd)GfuUfAf Ufucuauauuuua L96 | 1658 | AGGAAGGUUAUUC AUAUAUUA | 1835 |
| | anti-sense | VPusAfsaauAfuAfGfaa uaAfcCfuuccusgsu | 1717 | UAAAUAUAGAAUA ACCUUCCUGU | 1894 |
| AD-1069828 | sense | usgsucu(Uhd)UfaGfAf Afacugucagaa L96 | 1663 | UGUCUUUAGAAAC UGUCAGAA | 1840 |
| | anti-sense | VPusUfscugAfcAfGfuu ucUfaAfagacasusg | 1722 | UUCUGACAGUUUC UAAAGACAUG | 1899 |
| AD-1069829 | sense | ususuua(Ghd)CfgGfUf Ufugcaaacaaa L96 | 1664 | UUUUAGCGGUUU GCAAACAAA | 1841 |
| | anti-sense | VPusUfsuguUfuGfCfaa acCfgCfuaaaasgsu | 1723 | UUUGUUUGCAAAC CGCUAAAAGU | 1900 |
| AD-1069830 | sense | gscsggu(Uhd)UfgCfAfA facaaaaugaaL96 | 1665 | GCGGUUUGCAAAC AAAAUGAA | 1842 |
| | anti-sense | VPusUfscauUfuUfGfuu ugCfaAfaccgcsusa | 1724 | UUCAUUUUGUUU GCAAACCGCUA | 1901 |

45

TABLE 11

ATXN3 in vivo single-dose screen with one set of exemplary ATXN3
siRNA duplexes. In this table the column "Duplex Name" provides
the numerical part of the duplex name with a suffix
(number foUowing the decimal point in a duplex name) that merely
refers to a batch production number. The suffix can be omitted from the
duplex name without changing the chemical structure. For example, duplex
AD-368047.2 in Table 11 refers to the same duplex as AD-368047 in Table 2.

| Duplex Name | Strand | SEQ ID NO: | Modified Sequences (5'-3') |
|---|---|---|---|
| AD-368047.2 | sense | 21 | uscscaucUfuCfCfAfcgagaaacaaL96 |
| | anti-sense | 251 | usUfsguuu(Cgn)ucguggAfaGfauggascsu |
| AD-368049.2 | sense | 22 | csasucuuCfcAfCfGfagaaacaagaL96 |
| | anti-sense | 252 | usCfsuugu(Tgn)ucucguGfgAfagaugsgsa |
| AD-368050.2 | sense | 23 | asuscuucCfaCfGfAfgaaacaagaaL96 |
| | anti-sense | 253 | usUfscuug(Tgn)uucucgUfgGfaagausgsg |
| AD-368225.2 | sense | 28 | csasgcagCfcUfUfCfuggaaauauuL96 |
| | anti-sense | 258 | asAfsuauu(Tgn)ccagaaGfgCfugcugsusa |

TABLE 11-continued

ATXN3 in vivo single-dose screen with one set of exemplary ATXN3
siRNA duplexes. In this table the column "Duplex Name" provides
the numerical part of the duplex name with a suffix
(number foUowing the decimal point in a duplex name) that merely
refers to a batch production number. The suffix can be omitted from the
duplex name without changing the chemical structure. For example, duplex
AD-368047.2 in Table 11 refers to the same duplex as AD-368047 in Table 2.

| Duplex Name | Strand | SEQ ID NO: | Modified Sequences (5'-3') |
|---|---|---|---|
| AD-368337.2 | sense | 34 | asgsgaagGfuUfAfUfucuauauuugL96 |
| | anti-sense | 264 | csAfsaaua(Tgn)agaauaAfcCfuuccusgsu |
| AD-368427.2 | sense | 37 | asuscgacCfaAfAfAfcuuauuggauL96 |
| | anti-sense | 267 | asUfsccaa(Tgn)aaguuuUfgGfucgausgsc |
| AD-368721.2 | sense | 40 | ascsgagaAfgCfCfUfacuuugaaaaL96 |
| | anti-sense | 270 | usUfsuuca(Agn)aguaggCfuUfcucguscsu |
| AD-368869.2 | sense | 49 | csasugucUfuUfAfGfaaacugucauL96 |
| | anti-sense | 279 | asUfsgaca(Ggn)uuucuaAfaGfacaugsgsu |
| AD-368991.2 | sense | 54 | ususuuagCfgGfUfUfugcaaacaaaL96 |
| | anti-sense | 284 | usUfsuguu(Tgn)gcaaacCfgCfuaaaasgsu |
| AD-368996.2 | sense | 59 | gscsgguuUfgCfAfAfacaaaaugauL96 |
| | anti-sense | 289 | asUfscauu(Tgn)uguuugCfaAfaccgcsusa |
| AD-369082.2 | sense | 62 | gscsauucAfgCfAfAfuuaaagacauL96 |
| | anti-sense | 292 | asUfsgucu(Tgn)uaauugCfuGfaaugcscsu |
| AD-414322.2 | sense | 192 | uscsgaccAfaAfAfCfuuauuggagaL96 |
| | anti-sense | 422 | VPusCfsuccAfaUfAfaguuUfuGfgucgasusg |
| AD-368815.2 | sense | 45 | gsasgugaUfcUfAfGfgugaugcuauL96 |
| | anti-sense | 275 | asUfsagca(Tgn)caccuaGfaUfcacucscsc |
| AD-368871.2 | sense | 50 | usgsucuuUfaGfAfAfacugucagaaL96 |
| | anti-sense | 280 | usUfscuga(Cgn)aguuucUfaAfagacasusg |

In such studies, an AAV vector with a liver tropism harboring *Homo sapiens* ATXN3 (CDS and 3'UTR) was intravenously injected to 6-8 week old C57BL/6 female mice, and at 14 days post-AAV administration, a selected RNAi agent or a control agent were subcutaneously injected at 3 mg/kg to mice (n=3 per group), with mice sacrificed and livers assessed for ATXN3 mRNA levels at 14 days post-subcutaneous injection of RNAi agent or control. The duplexes summarized in Table 11, these were dosed at $2\times10^{11}$ viral particles per mouse. For the duplexes summarized in Table 10, these were dosed at $2\times10^{10}$ viral particles per mouse.

In mice injected with AAV expressing human ATXN3 transcript AD-368996, AD-369082, and AD-414322 produced the highest levels of human ATXN3 transcript knockdown. AD-368337, AD-368871, and AD-368815 produced intermediate levels of human ATXN3 transcript knockdown. AD-368991, AD-368047, AD-368427, AD-368050, AD-368869, AD-368049, AD-368225, or AD-368721 did not yield appreciable human ATXN3 transcript knockdown in human ATXN3 AAV-injected mice.

Figure 3A:
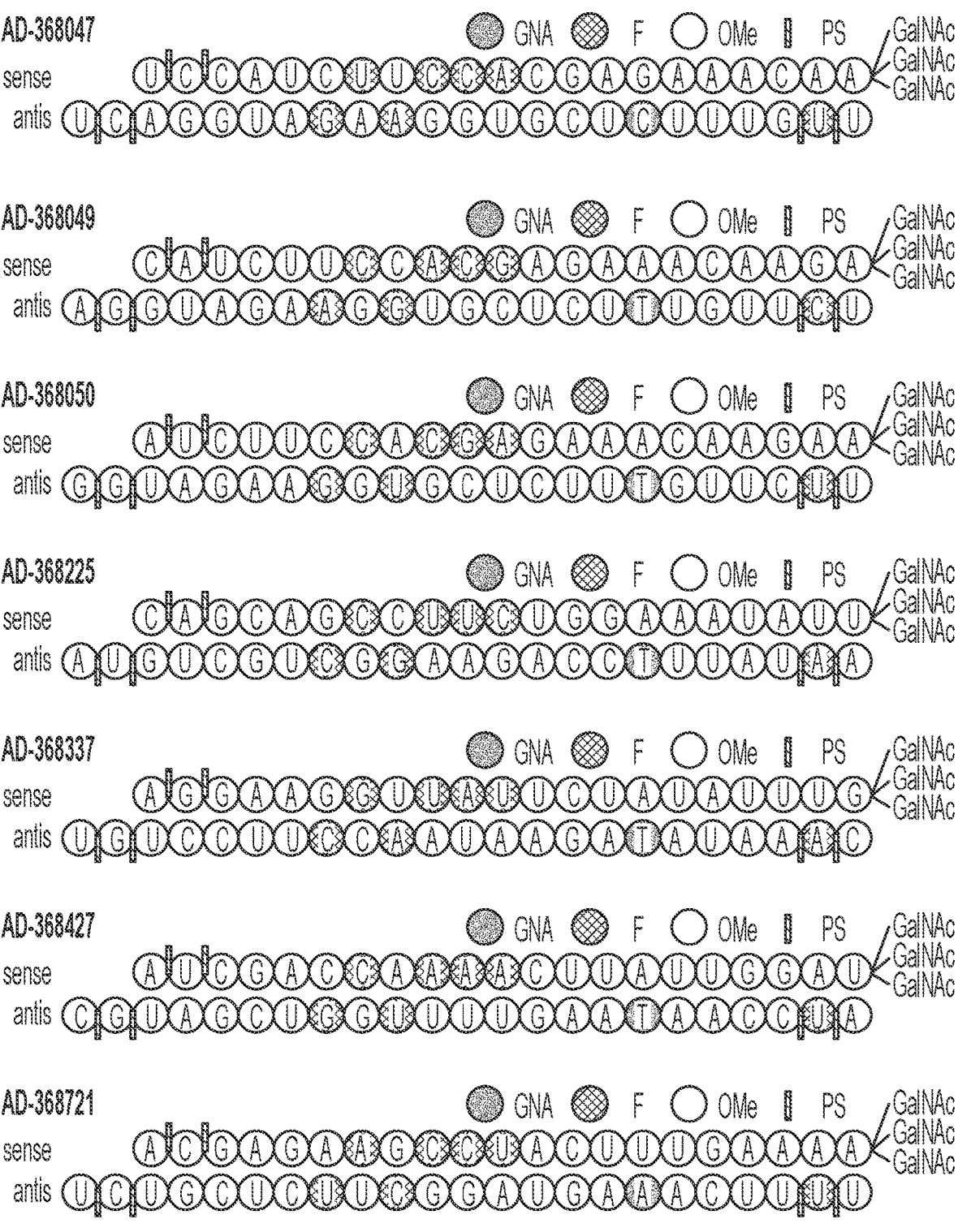
FIG. 3A-FIG. 3B depict the sequences and chemistry of the exemplary ATXN3 siRNAs, including AD-368047, AD-368049, AD-368050, AD-368225, AD-368337, AD-368427, AD-368721, AD-368869, AD-368991, AD-368996, AD-369082, AD-414322, AD-368815, and AD-368871 (corresponding to the duplex sequences in Table 11). For each siRNA, "F" is the "2'-fluoro" modification, OMe is a methoxy group, GNA refers to a glycol nucleic acid, and PS refers to the phosphorothiolate linkage.
Figure 3B:
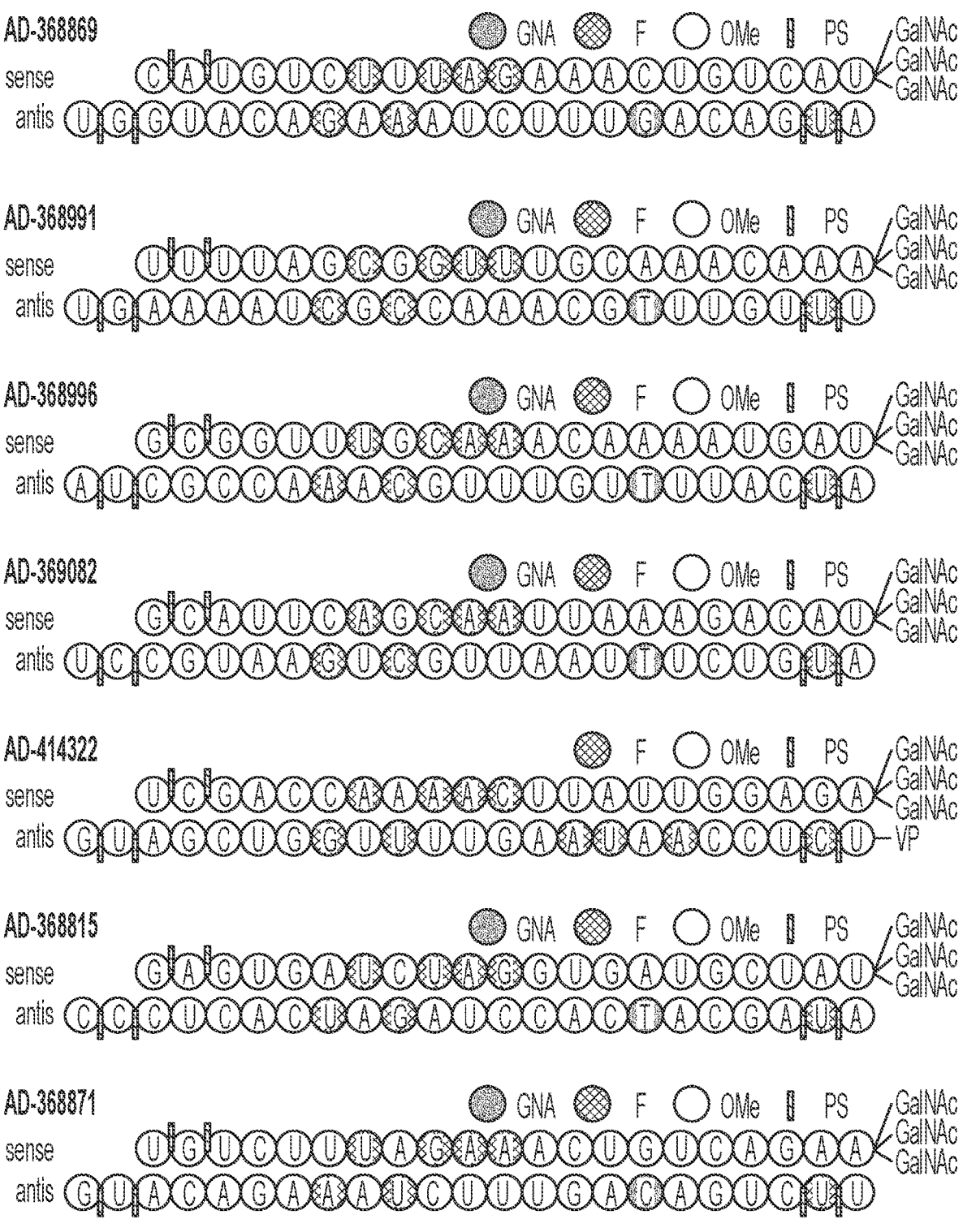
Figure 4:
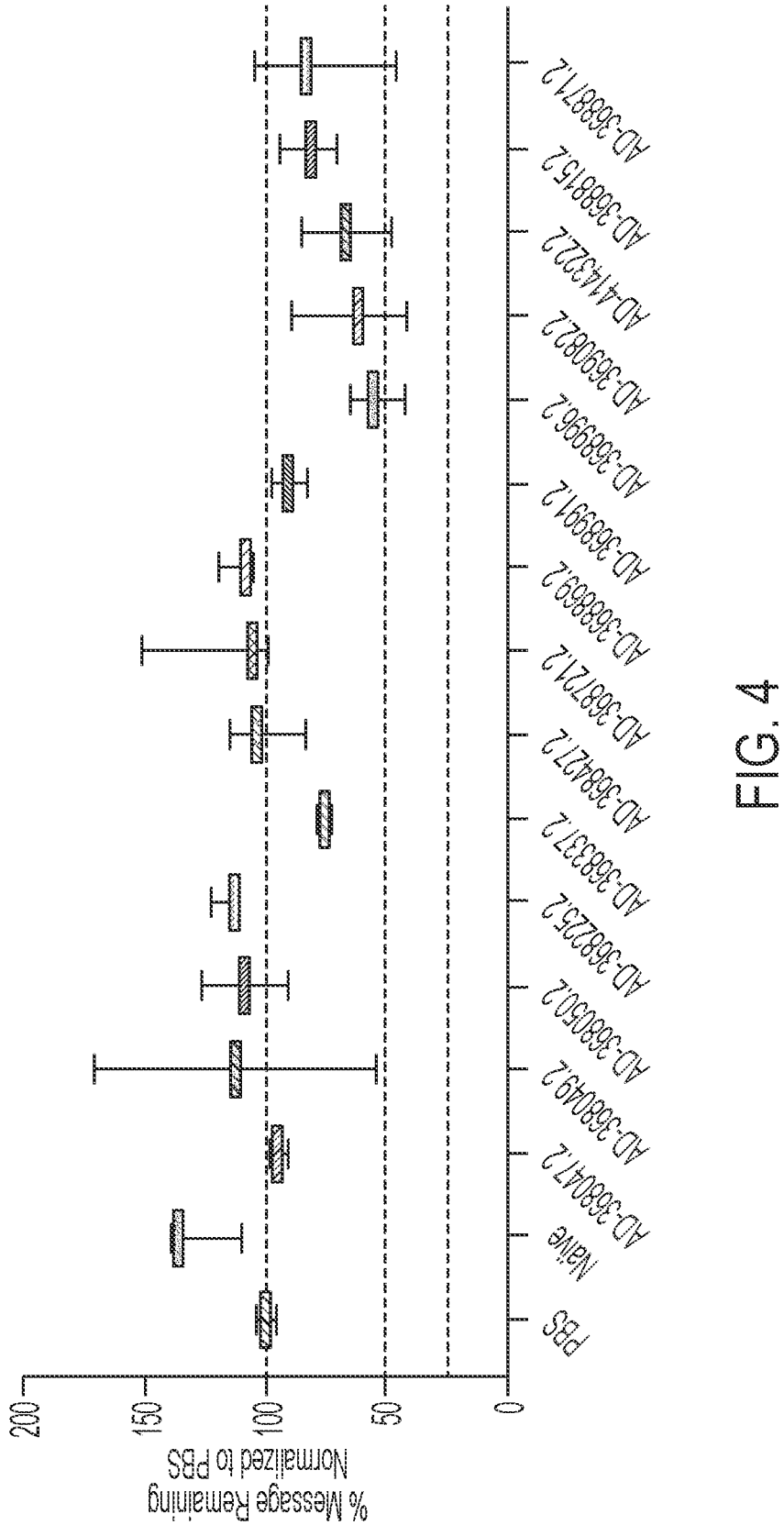
FIG. 4 is a graph depicting the percent ATXN3 message remaining normalized to PBS in mice on day 14 post-treatment with the exemplary duplexes indicated on the X-axis (from left to right: PBS control; naïve, non-injected control, AD-368047.2, AD-368049.2, AD-368050.2, AD-368225.2, AD-368337.2, AD-368427.2, AD-368721.2, AD-368869.2, AD-368991.2, AD-368996.2, AD-369082.2, AD-414322.2, AD-368815.2, and AD-368871.2).

More specifically, Table 13 and FIG. 4 demonstrate the results of the in vivo screen with the siRNA duplexes corresponding to the siRNA sequences in Table 11 and FIG. 3A-FIG. 3B. Of the siRNA duplexes evaluated in vivo in Table 13, 1 achieved ≥40% knockdown of ATXN3, 3 achieved ≥30% knockdown of ATXN3, 5 achieved ≥20% knockdown of ATXN3, 6 achieved ≥10% knockdown of ATXN3, and 8 achieved ≥5% knockdown of ATXN3.

TABLE 13

Efficacy of exemplary ATXN3 siRNAs in mice.
In this table the column "Duplex Name" provides the numerical part of the duplex name with a suffix (number following the decimal point in a duplex name) that merely refers to a batch production number. The suffix can be omitted from the duplex name without changing the chemical structure. For example, duplex AD-368047.2 in Table 13 refers to the same duplex as AD-368047 in Table 2.

| Duplex (Administered at 3 mg/kg) | Day 14 post-treatment | |
|---|---|---|
| | % ATXN3 Message Remaining | StDev |
| PBS | 100.0 | 4.0 |
| Naïve | 128.1 | 15.5 |
| AD-368047.2 | 94.9 | 3.8 |
| AD-368049.2 | 112.6 | 58.2 |
| AD-368050.2 | 109.0 | 17.8 |
| AD-368225.2 | 116.3 | 5.7 |
| AD-368337.2 | 76.0 | 2.4 |
| AD-368427.2 | 100.9 | 15.9 |
| AD-368721.2 | 118.8 | 28.6 |
| AD-368869.2 | 111.1 | 7.5 |
| AD-368991.2 | 90.6 | 7.3 |
| AD-368996.2 | 54.6 | 11.4 |
| AD-369082.2 | 64.7 | 23.7 |
| AD-414322.2 | 66.9 | 18.6 |
| AD-368815.2 | 82.2 | 11.8 |
| AD-368871.2 | 78.0 | 29.3 |

Table 12 and FIG. 2 demonstrate the results of the in vivo screen with the siRNA duplexes corresponding to the siRNA sequences in Table 10 and FIG. 1. Of the siRNA duplexes evaluated in vivo in Table 12, 1 achieved ≥80% knockdown of ATXN3, 3 achieved ≥70% knockdown of ATXN3, 4 achieved ≥60% knockdown of ATXN3, 6 achieved ≥50% knockdown of ATXN3, and 9 achieved ≥30% knockdown of ATXN3.

TABLE 12

Efficacy and duration of exemplary ATXN3 siRNAs in mice. In this table the column "Duplex Name" provides the numerical part of the duplex name with a suffix (number following the decimal point in a duplex name) that merely refers to a batch production number. The suffix can be omitted from the duplex name without changing the chemical structure. For example, duplex AD-1103843.2 in Table 12 refers to the same duplex as AD-1103843 in Table 10 and AD-1103843.1 in Table 7A.

| Duplex | Day 14 post-treatment | |
|---|---|---|
| (Administered at 3 mg/kg) | % ATXN3 Message Remaining | StDev |
| PBS | 100.00 | 44.33 |
| Naïve | 99.57 | 34.51 |
| AD-1103843.2 | 65.19 | 40.01 |
| AD-1069823.2 | 28.82 | 3.55 |
| AD-414356.2 | 68.69 | 9.00 |
| AD-1069828.2 | 42.45 | 13.44 |
| AD-1069829.2 | 17.47 | 13.70 |
| AD-1069830.2 | 29.50 | 16.17 |
| AD-1041266.2 | 32.10 | 25.81 |
| AD-368995.2 | 42.74 | 16.20 |
| AD-368996.2 | 50.66 | 13.59 |

Example 3—Knockdown of ATXN3 Expression in Mice that Express Human ATXN3 with a Single Dose ATXN3 siRNA Treatment A series of iRNA agents, e.g., lipid-modified iRNA agents, e.g., an iRNA agent of Table 5 or Table 14, targeting human ATXN3 are tested for the ability to knockdown expression of ATXN3 mRNA in 6 to 8-week-old ATXN3 transgenic of knock-in (KI) female mice. A single dose of the selected iRNA agents, or PBS control, are administered subcutaneously at 2, 3, 5 or 10 mg/kg (n=3, n=4 or n=5 per group). Two to four weeks after, the mice are sacrificed to assess knockdown of ATXN3 mRNA in the brain. Mice that are injected with ATXN3 iRNA show significant decrease in human ATXN3 transcript in the brain and spinal cord.

Example 4—Resolution of SCA3 Phenotypes in Human Mutant ATXN3-Expressing Mice after a Single Injection of siRNA A series of iRNA agents, e.g., lipid-modified iRNA agents, e.g., an iRNA agent of Table 5 or Table 14, targeting human ATXN3 are injected intracerebroventricularly into early symptomatic human mutant ATXN3 expressing mice at approximately 8 weeks of age. The pathological features and SCA3 behavior are evaluated at intervals between 16 and 32 weeks of age. Both brain pathology and behavior are significantly ameliorated at one or more timepoints between 16 and 32 weeks of age. The iRNA agents comprise a C16 ligand within the sense strand, a VP-modification at the 5'-terminus of the anti-sense strand, and a total of 6, 7, or 8 PS internucleotide modifications.

Example 5. RNAi Agent Design, Synthesis, Selection, and In Vitro Evaluation

This Example also describes methods for the design, synthesis, selection, and in vitro evaluation of ATXN3 RNAi agents.

Bioinformatics

Transcripts

A set of siRNAs targeting the human ataxin3 gene (ATXN3) was designed using custom R and Python scripts. Pairs of oligos were generated using bioinformatic methods and ranked, and exemplary pairs of oligos are shown in Tables 7A, 7B, and 14. Modified sequences are presented in Table 7A and Table 14, and unmodified sequences are presented in Table 7B. The number following the decimal point in a duplex name as indicated in the tables merely refers to a batch production number.

TABLE 7A

Exemplary Human ATXN3 siRNA Modified Single Strands and Duplex Sequences

Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position on mRNA (NM_001127697.2) that is complementary to the antisense strand of Column 7; in some embodiments, a duplex of Table 7A can also target NM_001164782.2. Column 9 indicates the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_001127697.2 | Seq ID NO: (mRNA target) |
|---|---|---|---|---|---|---|---|---|
| AD-1040648.1 | A-715489.1 | 1623 | asasacugUfcAfGfAfaaugauu ugaL96 | A-1929852.1 | 1682 | VPusCfsaaaUfcAfUfuuc ugAfcAfaguuuuscsu | AGAAACTGTCAGAAA TGATTTGA | 1741 |
| AD-1040649.1 | A-715491.1 | 1624 | asascuguCfaGfAfAfaugauu ugaaL96 | A-1929853.1 | 1683 | VPusUfscaaAfuCfAfuuu cUfgAfcagususuc | GAAACTGTCAGAAAT GATTTGAA | 1742 |
| AD-1040650.1 | A-715493.1 | 1625 | ascsugucAfgAfAfAfugauuug aaaL96 | A-1929854.1 | 1684 | VPusUfsucaAfaUfCfauu ucUfgUfacagususu | AAACTGTCAGAAATG ATTTGAAA | 1743 |
| AD-1040844.1 | A-1930203.1 | 1626 | usasgaaaCfuGfUfCfagaaaug auaL96 | A-1930204.1 | 1685 | VPusAfsucaUfuUfCfuga cAfgfufuucuasasa | UUUAGAAACUGUCA GAAAUGAUU | 1744 |
| AD-1040907.1 | A-715667.1 | 1627 | csasaagaGfaUfGfAfggaaaua agaL96 | A-1930311.1 | 1686 | VPusCfsuuaUfuUfCfcuc aUfcUfcuuugsasc | GTCAAAGAGATGAGG AAATAAGA | 1745 |
| AD-1041117.1 | A-1930696.1 | 1628 | csgsguuuGfcAfAfAfcaaaaug auaL96 | A-1930697.1 | 1687 | VPusAfsucaUfuUfUfguu uGfcAfaaccgscsu | AGCGGUUUGCAAAC AAAAUGAUG | 1746 |
| AD-1041266.1 | A-715887.1 | 1629 | gsasggcaUfuCfAfGfcaauuaa agaL96 | A-1930961.1 | 1688 | VPusCfsuuuAfaUfUfgcu gAfaUfgccucsusu | AAGAGGCATTCAGCA ATTAAAGA | 1747 |
| AD-1041321.1 | A-1931042.1 | 1630 | asgsgcauUfcAfGfCfaauuaaa gaaL96 | A-1931043.1 | 1689 | VPusUfscuuUfaAfUfugc uGfaAfugccuscsu | AGAGGCAUUCAGCA AUUAAAGAC | 1748 |
| AD-1041399.1 | A-716039.1 | 1631 | ususuuucUfuGfGfAfucuuuu ugcaL96 | A-1931194.1 | 1690 | VPusGfscaaAfaAfGfauc cAfaGfaaaaasusg | CATTTTTCTTGGATCT TTTTGCA | 1749 |
| AD-1041609.1 | A-1931550.1 | 1632 | gsgscuuuCfaUfUfUfcuaauu aacaL96 | A-1931551.1 | 1691 | VPusGfsuuaAfuAfAfgaa aUfgAfaagccsasc | GUGGCUUUCAUUUC UUAUUAACC | 1750 |
| AD-1041668.1 | A-1931617.1 | 1633 | usasaccaAfaUfUfUfaccuuuc agaL96 | A-1931618.1 | 1692 | VPusCfsugaAfaGfGfuua aUfuUfgguuasasu | AUUAACCAAAUUAAC CUUCAGG | 1751 |
| AD-1041823.1 | A-1931900.1 | 1634 | gscsuccaGfuGfUfUfuucuug uguaL96 | A-1931901.1 | 1693 | VPusAfsacAfcAfGfAfaaac AfcUfgggcsasc | GUGCUCCAGUGUUU UCUUGUGU | 1752 |
| AD-1041824.1 | A-1931902.1 | 1635 | csusccagUfgUfUfUfucuugu guuaL96 | A-1931903.1 | 1694 | VPusAfsacaCfaGfGfaaaa CfacUfuggagscsa | UGCUCCAGUGUUUU CUUGUGUG | 1753 |

TABLE 7A-continued

Exemplary Human ATXN3 siRNA Modified Single Strands and Duplex Sequences

Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position on mRNA (NM_001127697.2) that is complementary to the antisense strand of Column 7; in some embodiments, a duplex of Table 7A can also target NM_001164782.2. Column 9 indicates the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_001127697.2 | Seq ID NO: (mRNA target) |
|---|---|---|---|---|---|---|---|---|
| AD-1041837.1 | A-1931928.1 | 1636 | uscscugAfucCfAfCfaacuuuucuaL96 | A-1931929.1 | 1695 | VPusAfsgaaAfaGfUfugugAfuCfagagasasa | UUUCCUGAUCACAACUUUUCUG | 1754 |
| AD-1041838.1 | A-1931930.1 | 1637 | csuscugaUfcAfCfAfacuuuucugaL96 | A-1931931.1 | 1696 | VPusCfsagaAfaAfGfuuguGfaUfcagsgsasa | UUCUCUGAUCACAACUUUCUGC | 1755 |
| AD-1041839.1 | A-1931932.1 | 1638 | uscsugauCfacFfAfAfcuuuucugcaL96 | A-1931933.1 | 1697 | VPusGfscagAfaFfAfGfguugUfgAfucagsgsa | UCUCUGAUCACAACUUUCUGCU | 1756 |
| AD-1041850.1 | A-716567.1 | 1639 | csusgguuUfucCfAfUffuauuuucccaL96 | A-1931945.1 | 1698 | VPusGfsggaAfaFfUfaaugAfaAfaccagsgsu | ACCTGGTTTTCATTATTTTCCCA | 1757 |
| AD-1041858.1 | A-716593.1 | 1640 | ususuuucccCfaCfAfAfuucuuuugaaL96 | A-1931953.1 | 1699 | VPusUfscaaAfaGfAfauugUfgGfgaaausa | TATTTCCCACAATTCTTTGAA | 1758 |
| AD-1041860.1 | A-716595.1 | 1641 | ususucccAfcAfAfUfucuuuugaaaL96 | A-1931955.1 | 1700 | VPusUfsucaAfaFfaAfGfaauuGfuGfgaaasasu | ATTTTCCCACAATTCTTTGAAA | 1759 |
| AD-1041940.1 | A-1932100.1 | 1642 | csusaccuGfgUfUfUfucauuauuuaL96 | A-1932101.1 | 1701 | VPusAfsaauAfaUfGfaaaacFfCfAfgguagscsa | UGCUACCUGGUUUUCAUUAUUUU | 1760 |
| AD-1041942.1 | A-1932104.1 | 1643 | ascscuggUfuUfUfCfcauuauuuucaL96 | A-1932105.1 | 1702 | VPusGfsaaaAfuAfAffugaaAfaCffcaggusasg | CUACCUGGUUUUCAUUAUUUUCC | 1761 |
| AD-1041956.1 | A-1932132.1 | 1644 | csascaauUfcUfUfUfugaaagaugaL96 | A-1932133.1 | 1703 | VPusCfsaucUfuUfCfaaaaGfaAfuugugsgsg | CCCACAAUUCUUUGAAAGAUGG | 1762 |
| AD-1041962.1 | A-1932144.1 | 1645 | ususuugaAfaGfAfUfggguaaucuuaL96 | A-1932145.1 | 1704 | VPusAfsagaUfuAfCffcaucUfUfUfcaaasgsa | UCUUUGAAAGAUGGUAAUCUUU | 1763 |
| AD-1041966.1 | A-1932152.1 | 1646 | gsasaagaUfgGfUfAfaucuuuucuaL96 | A-1932153.1 | 1705 | VPusAfsgaaAfaGfAfuuaacCfaUfcuuucsasa | UUGAAAGAUGGUAAUCUUUUCUG | 1764 |
| AD-1042066.1 | A-1932306.1 | 1647 | ususccuaAfaCfUfCfugaaaucagaL96 | A-1932307.1 | 1706 | VPusCfsugaUfuUfCfagagUfuUfaggaascsg | CGUUCCUAAACUCUGAAAUCAGC | 1765 |
| AD-1042138.1 | A-716829.1 | 1648 | csasaguaCfuUfGfGfAfgaauaaaugaL96 | A-1932433.1 | 1707 | VPusCfsauuUfaUfUfcucaAfgUfacuugsusg | CACAAGTACTTGAGAATAAATGA | 1766 |
| AD-1042150.1 | A-716889.1 | 1649 | csusuuccCfaGfAfUfgcuuuaugaaL96 | A-1932445.1 | 1708 | VPusUfscauAfaAfGfcauucUfgGfgaaagscsa | TGCTTTCCCAGATGCTTTATGAA | 1767 |

TABLE 7A-continued

Exemplary Human ATXN3 siRNA Modified Single Strands and Duplex Sequences

Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position on mRNA (NM_001127697.2) that is complementary to the antisense strand of Column 7; in some embodiments, a duplex of Table 7A can also target NM 001164782.2. Column 9 indicates the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_001127697.2 | Seq ID NO: (mRNA target) |
|---|---|---|---|---|---|---|---|---|
| AD-1042171.1 | A-1932478.1 | 1650 | asasguacUfuGfAfGfaauaaa ugaaL96 | A-1932479.1 | 1709 | VPusUfscauUfuAfUfucu cAfaGfuacuusgsu | ACAAGUACUUGAGA AUAAAUGAG | 1768 |
| AD-1042195.1 | A-1932526.1 | 1651 | ususucccAfgAfUfGfcuuuau gaaaL96 | A-1932527.1 | 1710 | VPusUfscaUfaAfAfgca uCfuGfggaaasgsc | GCUUUCCCAGAUGC UUUAUGAAU | 1769 |
| AD-1042315.1 | A-1932724.1 | 1652 | csasaaacCftuUfAfCfagcuuug uuaL96 | A-1932725.1 | 1711 | VPusAfsacaAfaGfCfugu aAfgGfuuuugsasu | AUCAAAACCUUACAG CUUGUUG | 1770 |
| AD-1042316.1 | A-1932726.1 | 1653 | asasaaccUfuAfCfAfgcuuugu ugaL96 | A-1932727.1 | 1712 | VPusCfsaacAfaGfGfcug uAfaGfguuuusgsa | UCAAAACCUUACAGC UUUGUUGC | 1771 |
| AD-1069819.1 | A-1985512.1 | 1654 | uscscau(Chd)UfuCfCfAfcga gaaacaaL96 | A-802047.1 | 1713 | VPusUfsguuUfcUfCfgug gAfaGfauggascsu | AGTCCATCTTCCACGA GAAACAA | 1772 |
| AD-1069820.1 | A-1985513.1 | 1655 | csasucu(Uhd)CfcAfCfGfaga aacaagaL96 | A-802048.1 | 1714 | VPusCfsuugUftUfCfucg uGfgAfagausgsga | TCCATCTTCCACGAGA AACAAGA | 1773 |
| AD-1069821.1 | A-1985514.1 | 1656 | asuscuu(Chd)CfaCfGfAfgaa acaagaaL96 | A-802049.1 | 1715 | VPusUfscuuGfuUfUfcuc gUfgGfaagausgsg | CCATCTTCCACGAGAA ACAAGAA | 1774 |
| AD-1069822.1 | A-1985515.1 | 1657 | csasgca(Ghd)CfcUfUfCftugg aaauauaL96 | A-802364.1 | 1716 | VPusAfsuauUfcCfCfaga aGfgCfugcugsusa | TACAGCAGCCTTCTG GAAATATG | 1775 |
| AD-1069823.1 | A-1985516.1 | 1658 | asgsgaa(Ghd)GfuUfAfUfucu auauuuaL96 | A-1985517.1 | 1717 | VPusAfsaauAfuAfGfaau aAfcCfuuccusgsu | ACAGGAGGTTATTC TATATTTG | 1776 |
| AD-1069824.1 | A-1985518.1 | 1659 | asuscga(Chd)CfaAfAfAfcuu auuggaaL96 | A-802958.1 | 1718 | VPusUfsccaAfuAfAfguu uUfgGfucgausgsc | GCATCGACCAAAACT TATTGGAG | 1777 |
| AD-1069825.1 | A-1985519.1 | 1660 | ascsgag(Ahd)AfgCfCfUfacu uugaaaL96 | A-803392.1 | 1719 | VPusUfsuucAfaAfGfuag gCftuUfcucguscscu | AGACGAGAAGCCTAC TTTGAAAA | 1778 |
| AD-1069826.1 | A-1985520.1 | 1661 | gsasgug(Ahd)UfcUfAfGfgug augcuaaL96 | A-1929576.1 | 1720 | VPusUfsagcAfucUfAfccua GfaUfcacucscsc | GGGAGUGGAUCUAGG UGAUGCUAU | 1779 |
| AD-1069827.1 | A-1985521.1 | 1662 | csasugu(Chd)UfuUfAfGfaaa cgucaaL96 | A-1930196.1 | 1721 | VPusUfsgacAfgUfUfucU aAfaGfacaugsgsu | ACCAUGCUUUAGA AACUGUCAG | 1780 |
| AD- | A-1985522.1 | 1663 | usgsucu(Uhd)UfaGfAfAfacu | A-1929846.1 | 1722 | VPusUfscugAfcAfGfuuu | CAUGUCUUUAGAAA | 1781 |

TABLE 7A-continued

Exemplary Human ATXN3 siRNA Modified Single Strands and Duplex Sequences

Column 1 indicates duplex name. Column 2 indicates the name of the sense sequence. Column 3 indicates the sequence ID for the sequence of column 4. Column 4 provides the modified sequence of a sense strand suitable for use in a duplex described herein. Column 5 indicates the antisense sequence name. Column 6 indicates the sequence ID for the sequence of column 7. Column 7 provides the sequence of a modified antisense strand suitable for use in a duplex described herein, e.g., a duplex comprising the sense sequence in the same row of the table. Column 8 indicates the position on mRNA (NM_001127697.2) that is complementary to the antisense strand of Column 7; in some embodiments, a duplex of Table 7A can also target NM 001164782.2. Column 9 indicates the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_001127697.2 | Seq ID NO: (mRNA target) |
|---|---|---|---|---|---|---|---|---|
| 1069928.1 | | | gucagaaL96 | | | cUfaAfagacasusg | CUGUCAGAA | |
| AD-1069829.1 | A-1985523.1 | 1664 | ususuua(Ghd)CfgGfUfUfugc aaacaaaL96 | A-1930524.1 | 1723 | VPusUfsguUfuGfCfaaa ccfgCfuaaaasgsu | ACUUUAGCGGUUU GCAAACAAA | 1782 |
| AD-1069830.1 | A-1985524.1 | 1665 | gscsggu(Uhd)UfgCfAfAfaca aaaugaaL96 | A-1930695.1 | 1724 | VPusUfscauUfuUfGfuuu gCfaAfaccgcsusa | UAGCGGUUGCAAA CAAAAUGAU | 1783 |
| AD-1069831.1 | A-1985525.1 | 1666 | gscsauu(Chd)AfgCfAfAfuua aagacaaL96 | A-1931045.1 | 1725 | VPusUfsgucUfuUfAfauu gCfuGfaaugcscsu | AGGCAUUCAGCAAU UAAAGACAU | 1784 |
| AD-1069832.1 | A-1985526.1 | 1667 | uscsgac(Chd)AfaAfAfCfuua uuggagaL96 | A-802900.1 | 1726 | VPusCfsuccAfaUfAfagu uUfuGfgucgasusg | CATCGACCAAAACTTA TTGGAGA | 1785 |
| AD-1103836.1 | A-713825.1 | 1668 | uscscaucUfuCfCfAfcgagaaa caaL96 | A-2051816.1 | 1727 | VPusUfsguuu(Cgn)ucgu ggAfaGfauggascsu | AGTCCATCTTCCACGA GAAACAA | 1786 |
| AD-1103837.1 | A-713829.1 | 1669 | csasucuuCfcAfCfCfagaaaaca agaL96 | A-2051817.1 | 1728 | VPusCfsuugu(Tgn)ucucg uGfgAfagaugsgsa | TCCATCTTCCACGAGA AACAAGA | 1787 |
| AD-1103838.1 | A-713831.1 | 1670 | asusucuucCfaCfGfAfagaaacaa gaaL96 | A-2051818.1 | 1729 | VPusUfscuug(Tgn)uucu cgUfgGfaagausgsg | CCATCTTCCACGAGAA ACAAGA | 1788 |
| AD-1103839.1 | A-802363.1 | 1671 | csasgcagCfcUfUfCfuggaaau auaL96 | A-2051819.1 | 1730 | VPusAfsuauu(Tgn)ccaga aGfgCfugcugsusa | TACAGCAGCCTTCTG GAAATATG | 1789 |
| AD-1103840.1 | A-2051820.1 | 1672 | asgsgaagGfuUfAfUfucuaua uuuaL96 | A-2051821.1 | 1731 | VPusAfsaaua(Tgn)agaa uaAfcCfuuccugsu | ACAGGAAGGTTATTC TATATTTG | 1790 |
| AD-1103841.1 | A-802957.1 | 1673 | asusucgacCfaAfAfAfcuuauug gaaL96 | A-2051822.1 | 1732 | VPusUfscaa(Tgn)aaguu uUfgCfucgausgsc | GCATCGACCAAAACT TATTGGAG | 1791 |
| AD-1103842.1 | A-715171.1 | 1674 | ascsgagaAfgCfcUfUfacuuuga aaaL96 | A-2051823.1 | 1733 | VPusUfsuuca(Agn)agua ggCftUfcugcuscsu | AGACGAGAAGCCTAC TTTGAAAA | 1792 |
| AD-1103843.1 | A-1929575.1 | 1675 | gsasgugaUfcUfAfGfgugaugc uaaL96 | A-2051824.1 | 1734 | VPusUfsagca(Tgn)caccu aGfaUfcacucscsc | GGGAGUGAUCUAGG UGAUGCUAU | 1793 |
| AD-1103844.1 | A-1930195.1 | 1676 | csasugucUfuUfAfGfguaugc ucaaL96 | A-2051825.1 | 1735 | VPusUfsgaca(Ggn)uuuc uaAfaGfacaugsgsu | ACCAUGUCUUUAGA AACUGUCAG | 1794 |

TABLE 7A-continued

Exemplary Human ATXN3 siRNA Modified Single Strands and Duplex Sequences

Column 1 indicates duplex name. Column 2 indicates the name of the sense sequence. Column 3 indicates the sequence ID for the sequence of
column 4. Column 4 provides the modified sequence of a sense strand suitable for use in a duplex described herein. Column 5 indicates the
antisense sequence name. Column 6 indicates the sequence ID for the sequence of column 7. Column 7 provides the sequence of a modified
antisense strand suitable for use in a duplex described herein, e.g., a duplex comprising the sense sequence in the same row of the table.
Column 8 indicates the position on mRNA (NM_001127697.2) that is complementary to the antisense strand of Column 7; in some
embodiments, a duplex of Table 7A can also target NM_001164782.2. Column 9 indicates the sequence ID for the sequence of column 8.

| Duplex Name | Sense sequence name | Seq ID NO: (sense) | Sense sequence (5'-3') | Antisense sequence name | Seq ID NO: (antisense) | Antisense sequence (5'-3') | mRNA target sequence in NM_001127697.2 | Seq ID NO: (mRNA target) |
|---|---|---|---|---|---|---|---|---|
| AD-1103845.1 | A-715471.1 | 1677 | usgsucuuUfaGfAfAfacuguc agaaL96 | A-2051826.1 | 1736 | VPusUfscuga(Cgn)aguu ucUfaAfagacasusg | CATGTCTTTAGAAACT GTCAGAA | 1795 |
| AD-1103846.1 | A-715711.1 | 1678 | ususuuagCfgGfUfUfugcaaa caaaL96 | A-2051827.1 | 1737 | VPusUfsuguu(Tgn)gcaa acCfgCfuaaaagsu | ACTTTTAGCGGTTTGC AAACAAA | 1796 |
| AD-1103847.1 | A-1930694.1 | 1679 | gscsgguuUfgCfAfAfacaaaau gaaL96 | A-2051828.1 | 1738 | VPusUfscauu(Tgn)uguu ugCfaAfaccgcsusa | UAGCGGUUUGCAAA CAAAAUGAU | 1797 |
| AD-1103848.1 | A-1931044.1 | 1680 | gscsauucAfgCfAfAfuuaaaga caaL96 | A-2051829.1 | 1739 | VPusUfsgucu(Tgn)uaau ugCfuGfaaugcscsu | AGGCAUUCAGCAAU UAAAGACAU | 1798 |
| AD-414322.3 | A-714587.1 | 1681 | uscsgaccaAfaAfAfCfuuauugg agaL96 | A-802900.1 | 1740 | VPusCfsuccAfaUfAfagu uUfuGfgucgasusg | CATCGACCAAAACTTA TTGGAGA | 1799 |

TABLE 7B

Exemplary Human ATXN3 Unmodified Single Strands and Duplex Sequences.
Column 1 indicates duplex name; the number foUowing the decimal point in a
duplex name merely refers to a batch production number. Column 2 indicates
the sense sequence name. Column 3 indicates  the sequence ID for the sequence of
column 4. Column 4 provides the unmodified sequence of a sense strand suitable for use
in a duplex described herein. Column 5 provides the position in the target mRNA
(typicaUy NM_001127697.2 or a homolog thereof) of the sense strand
of Column 4. Column 6 indicates the antisense sequence name. Column
7 indicates the sequence ID for the sequence of column 8. Column 8
provides the sequence of an antisense strand suitable for use in a duplex
described herein, without specifying chemical modifications. Column 9
indicates the position in the target mRNA (typicaUy NM_001127697.2
or a homolog thereof) that is complementary to the antisense strand
of Column 8; in some embodiments, a duplex of Table 7B can also target NM_001164782.2.

| Duplex Name | Sense sequence name | Seq ID NO: (sense) | Sense sequence (5'-3') | mRNA target range in NM_001127697.2 | Antisense sequence name | Seq ID NO: (anti-sense) | antisense sequence (5'-3') | mRNA target range in NM_001127697.2 |
|---|---|---|---|---|---|---|---|---|
| AD-1040648.1 | A-715489.1 | 1800 | AAACUGUCAGAAAU GAUUUGA | 477-497 | A-1929852.1 | 1859 | UCAAAUCAUUUCUG ACAGUUUCU | 475-497 |
| AD-1040649.1 | A-715491.1 | 1801 | AACUGUCAGAAAUG AUUUGAA | 962-982 | A-1929853.1 | 1860 | UUCAAAUCAUUUCU GACAGUUUC | 960-982 |
| AD-1040650.1 | A-715493.1 | 1802 | ACUGUCAGAAAUGA UUUGAAA | 963-983 | A-1929854.1 | 1861 | UUUCAAAUCAUUUC UGACAGUUU | 961-983 |
| AD-1040844.1 | A-1930203.1 | 1803 | UAGAAACUGUCAGA AAUGAUA | 959-979 | A-1930204.1 | 1862 | UAUCAUUUCUGACA GUUUCUAAA | 957-979 |
| AD-1040907.1 | A-715667.1 | 1804 | CAAAGAGAUGAGGA AAUAAGA | 964-984 | A-1930311.1 | 1863 | UCUUAUUUCCUCAU CUCUUUGAC | 962-984 |
| AD-1041117.1 | A-1930696.1 | 1805 | CGGUUUGCAAACAA AAUGAUA | 1115-1135 | A-1930697.1 | 1864 | UAUCAUUUUGUUU GCAAACCGCU | 1113-1135 |
| AD-1041266.1 | A-715887.1 | 1806 | GAGGCAUUCAGCAA UUAAAGA | 1087-1107 | A-1930961.1 | 1865 | UCUUUAAUUGCUG AAUGCCUCUU | 1085-1107 |
| AD-1041321.1 | A-1931042.1 | 1807 | AGGCAUUCAGCAAU UAAAGAA | 1198-1218 | A-1931043.1 | 1866 | UUCUUUAAUUGCU GAAUGCCUCU | 1196-1218 |
| AD-1041399.1 | A-716039.1 | 1808 | UUUUUCUUGGAUCU UUUUGCA | 1197-1217 | A-1931194.1 | 1867 | UGCAAAAAGAUCCA AGAAAAAUG | 1195-1217 |
| AD-1041609.1 | A-1931550.1 | 1809 | GGCUUUCAUUUCUU AUUAACA | 1407-1427 | A-1931551.1 | 1868 | UGUUAAUAAGAAA UGAAAGCCAC | 1405-1427 |
| AD-1041668.1 | A-1931617.1 | 1810 | UAACCAAAUUAACCU UUCAGA | 1423-1443 | A-1931618.1 | 1869 | UCUGAAAGGUUAA UUUGGUUAAU | 1421-1443 |
| AD-1041823.1 | A-1931900.1 | 1811 | GCUCCAGUGUUUUC UUGUGUA | 1526-1546 | A-1931901.1 | 1870 | UACACAAGAAACA CUGGAGCAC | 1524-1546 |
| AD-1041824.1 | A-1931902.1 | 1812 | CUCCAGUGUUUUCU UGUGUUA | 1527-1547 | A-1931903.1 | 1871 | UAACACAAGAAAC ACUGGAGCA | 1525-1547 |
| AD-1041837.1 | A-1931928.1 | 1813 | UCUCUGAUCACAACU UUUCUA | 1551-1571 | A-1931929.1 | 1872 | UAGAAAAGUUGUG AUCAGAGAA | 1549-1571 |
| AD-1041838.1 | A-1931930.1 | 1814 | CUCUGAUCACAACUU UUCUGA | 1552-1572 | A-1931931.1 | 1873 | UCAGAAAAGUUGU GAUCAGAGAA | 1550-1572 |
| AD-1041839.1 | A-1931932.1 | 1815 | UCUGAUCACAACUU UUCUGCA | 1553-1573 | A-1931933.1 | 1874 | UGCAGAAAAGUUG UGAUCAGAGA | 1551-1573 |
| AD-1041850.1 | A-716567.1 | 1816 | CUGGUUUUCAUUAU UUUCCCA | 1293-1313 | A-1931945.1 | 1875 | UGGGAAAAUAAUG AAAACCAGGU | 1291-1313 |
| AD-1041858.1 | A-716593.1 | 1817 | UUUUCCCACAAUUC UUUUGAA | 1576-1596 | A-1931953.1 | 1876 | UUCAAAAGAAUUG UGGGAAAAUA | 1574-1596 |
| AD-1041860.1 | A-716595.1 | 1818 | UUUCCCACAAUUCU UUUGAAA | 1589-1609 | A-1931955.1 | 1877 | UUUCAAAAGAAUU GUGGGAAAU | 1587-1609 |
| AD-1041940.1 | A-1932100.1 | 1819 | CUACCUGGUUUUCA UUAUUUA | 1572-1592 | A-1932101.1 | 1878 | UAAAUAAUGAAAAC CAGGUAGCA | 1570-1592 |

TABLE 7B-continued

Exemplary Human ATXN3 Unmodified Single Strands and Duplex Sequences.
Column 1 indicates duplex name; the number foUowing the decimal point in a
duplex name merely refers to a batch production number. Column 2 indicates
the sense sequence name. Column 3 indicates the sequence ID for the sequence of
column 4. Column 4 provides the unmodified sequence of a sense strand suitable for use
in a duplex described herein. Column 5 provides the position in the target mRNA
(typicaUy NM_001127697.2 or a homolog thereof) of the sense strand
of Column 4. Column 6 indicates the antisense sequence name. Column
7 indicates the sequence ID for the sequence of column 8. Column 8
provides the sequence of an antisense strand suitable for use in a duplex
described herein, without specifying chemical modifications. Column 9
indicates the position in the target mRNA (typicaUy NM_001127697.2
or a homolog thereof) that is complementary to the antisense strand
of Column 8; in some embodiments, a duplex of Table 7B can also target NM_001164782.2.

| Duplex Name | Sense sequence name | Seq ID NO: (sense) | Sense sequence (5'-3') | mRNA target range in NM_001127697.2 | Antisense sequence name | Seq ID NO: (anti-sense) | antisense sequence (5'-3') | mRNA target range in NM_001127697.2 |
|---|---|---|---|---|---|---|---|---|
| AD-1041942.1 | A-1932104.1 | 1820 | ACCUGGUUUUCAUUAUUUUCA | 1574-1594 | A-1932105.1 | 1879 | UGAAAAUAAUGAAAACCAGGUAG | 1572-1594 |
| AD-1041956.1 | A-1932132.1 | 1821 | CACAAUUCUUUUGAAAGAUGA | 1595-1615 | A-1932133.1 | 1880 | UCAUCUUUCAAAAGAAUUGUGGG | 1593-1615 |
| AD-1041962.1 | A-1932144.1 | 1822 | UUUUGAAAGAUGGUAAUCUUA | 1603-1623 | A-1932145.1 | 1881 | UAAGAUUACCAUCUUUCAAAAGA | 1601-1623 |
| AD-1041966.1 | A-1932152.1 | 1823 | GAAAGAUGGUAAUCUUUUCUA | 1607-1627 | A-1932153.1 | 1882 | UAGAAAAGAUUACCAUCUUUCAA | 1605-1627 |
| AD-1042066.1 | A-1932306.1 | 1824 | UUCCUAAACUCUGAAAUCAGA | 1680-1700 | A-1932307.1 | 1883 | UCUGAUUUCAGAGUUUAGGAACG | 1678-1700 |
| AD-1042138.1 | A-716829.1 | 1825 | CAAGUACUUGAGAAUAAAUGA | 1590-1610 | A-1932433.1 | 1884 | UCAUUUAUUCUCAAGUACUUGUG | 1588-1610 |
| AD-1042150.1 | A-716889.1 | 1826 | CUUUCCCAGAUGCUUUAUGAA | 1707-1727 | A-1932445.1 | 1885 | UUCAUAAAGCAUCUGGGAAAGCA | 1705-1727 |
| AD-1042171.1 | A-1932478.1 | 1827 | AAGUACUUGAGAAUAAAUGAA | 1708-1728 | A-1932479.1 | 1886 | UUCAUUUAUUCUCAAGUACUUGU | 1706-1728 |
| AD-1042195.1 | A-1932526.1 | 1828 | UUUCCCAGAUGCUUUAUGAAA | 1756-1776 | A-1932527.1 | 1887 | UUUCAUAAAGCAUCUGGGAAAGC | 1754-1776 |
| AD-1042315.1 | A-1932724.1 | 1829 | CAAAACCUUACAGCUUUGUUA | 1793-1813 | A-1932725.1 | 1888 | UAACAAAGCUGUAAGGUUUUGAU | 1791-1813 |
| AD-1042316.1 | A-1932726.1 | 1830 | AAAACCUUACAGCUUUGUUGA | 1794-1814 | A-1932727.1 | 1889 | UCAACAAAGCUGUAAGGUUUUGA | 1792-1814 |
| AD-1069819.1 | A-1985512.1 | 1831 | UCCAUCUUCCACGAGAAACAA | 768-788 | A-802047.1 | 1890 | UUGUUUCUCGUGGAAGAUGGACU | 766-788 |
| AD-1069820.1 | A-1985513.1 | 1832 | CAUCUUCCACGAGAAACAAGA | 953-973 | A-802048.1 | 1891 | UCUUGUUUCUCGUGGAAGAUGGA | 951-973 |
| AD-1069821.1 | A-1985514.1 | 1833 | AUCUUCCACGAGAAACAAGAA | 1109-1129 | A-802049.1 | 1892 | UUCUUGUUUCUCGUGGAAGAUGG | 1107-1129 |
| AD-1069822.1 | A-1985515.1 | 1834 | CAGCAGCCUUCUGGAAAUAUA | 1755-1775 | A-802364.1 | 1893 | UAUAUUUCCAGAAGGCUGCUGUA | 1753-1775 |
| AD-1069823.1 | A-1985516.1 | 1835 | AGGAAGGUUAUUCUAUAUUUA | 76-96 | A-1985517.1 | 1894 | UAAAUAUAGAAUAACCUUCCUGU | 74-96 |
| AD-1069824.1 | A-1985518.1 | 1836 | AUCGACCAAAACUUAUUGGAA | 78-98 | A-802958.1 | 1895 | UUCCAAUAAGUUUUGGUCGAUGC | 76-98 |
| AD-1069825.1 | A-1985519.1 | 1837 | ACGAGAAGCCUACUUUGAAAA | 79-99 | A-803392.1 | 1896 | UUUUCAAAGUAGGCUUCUCGUCU | 77-99 |
| AD-1069826.1 | A-1985520.1 | 1838 | GAGUGAUCUAGGUGAUGCUAA | 897-917 | A-1929576.1 | 1897 | UUAGCAUCACCUAGAUCACUCCC | 895-917 |
| AD-1069827.1 | A-1985521.1 | 1839 | CAUGUCUUUAGAAACUGUCAA | 951-971 | A-1930196.1 | 1898 | UUGACAGUUUCUAAAGACAUGGU | 949-971 |

TABLE 7B-continued

Exemplary Human ATXN3 Unmodified Single Strands and Duplex Sequences.
Column 1 indicates duplex name; the number foUowing the decimal point in a
duplex name merely refers to a batch production number. Column 2 indicates
the sense sequence name. Column 3 indicates the sequence ID for the sequence of
column 4. Column 4 provides the unmodified sequence of a sense strand suitable for use
in a duplex described herein. Column 5 provides the position in the target mRNA
(typicaUy NM_001127697.2 or a homolog thereof) of the sense strand
of Column 4. Column 6 indicates the antisense sequence name. Column
7 indicates the sequence ID for the sequence of column 8. Column 8
provides the sequence of an antisense strand suitable for use in a duplex
described herein, without specifying chemical modifications. Column 9
indicates the position in the target mRNA (typicaUy NM_001127697.2
or a homolog thereof) that is complementary to the antisense strand
of Column 8; in some embodiments, a duplex of Table 7B can also target NM_001164782.2.

| Duplex Name | Sense sequence name | Seq ID NO: (sense) | Sense sequence (5'-3') | mRNA target range in NM_001127697.2 | Antisense sequence name | Seq ID NO: (anti-sense) | antisense sequence (5'-3') | mRNA target range in NM_001127697.2 |
|---|---|---|---|---|---|---|---|---|
| AD-1069828.1 | A-1985522.1 | 1840 | UGUCUUUAGAAACUGUCAGAA | 953-973 | A-1929846.1 | 1899 | UUCUGACAGUUUCUAAAGACAUG | 951-973 |
| AD-1069829.1 | A-1985523.1 | 1841 | UUUUAGCGGUUUGCAAACAAA | 1109-1129 | A-1930524.1 | 1900 | UUUGUUUGCAAACCGCUAAAAGU | 1107-1129 |
| AD-1069830.1 | A-1985524.1 | 1842 | GCGGUUUGCAAACAAAAUGAA | 1114-1134 | A-1930695.1 | 1901 | UUCAUUUUGUUUGCAAACCGCUA | 1112-1134 |
| AD-1069831.1 | A-1985525.1 | 1843 | GCAUUCAGCAAUUAAAGACAA | 1200-1220 | A-1931045.1 | 1902 | UUGUCUUUAAUUGCUGAAUGCCU | 1198-1220 |
| AD-1069832.1 | A-1985526.1 | 1844 | UCGACCAAAACUUAUUGGAGA | 256-276 | A-802900.1 | 1903 | UCUCCAAUAAGUUUUGGUCGAUG | 254-276 |
| AD-1103836.1 | A-713825.1 | 1845 | UCCAUCUUCCACGAGAAACAA | 386-406 | A-2051816.1 | 1904 | UUGUUUCUCGUGGAAGAUGGACU | 384-406 |
| AD-1103837.1 | A-713829.1 | 1846 | CAUCUUCCACGAGAAACAAGA | 476-496 | A-2051817.1 | 1905 | UCUUGUUCUCGUGGAAGAUGGA | 474-496 |
| AD-1103838.1 | A-713831.1 | 1847 | AUCUUCCACGAGAAACAAGAA | 768-788 | A-2051818.1 | 1906 | UUCUUGUUUCUCGUGGAAGAUGG | 766-788 |
| AD-1103839.1 | A-802363.1 | 1848 | CAGCAGCCUUCUGGAAAUAUA | 477-497 | A-2051819.1 | 1907 | UAUAUUCCAGAAGGCUGCUGUA | 475-497 |
| AD-1103840.1 | A-2051820.1 | 1849 | AGGAAGGUUAUUCUAUAUUUA | 76-96 | A-2051821.1 | 1908 | UAAAUAUAGAAUAACCUUCCUGU | 74-96 |
| AD-1103841.1 | A-802957.1 | 1850 | AUCGACCAAAACUUAUUGGAA | 78-98 | A-2051822.1 | 1909 | UUCCAAUAAGUUUUGGUCGAUGC | 76-98 |
| AD-1103842.1 | A-715171.1 | 1851 | ACGAGAAGCCUACUUUGAAA | 79-99 | A-2051823.1 | 1910 | UUUUCAAAGUAGGCUUCUCGUCU | 77-99 |
| AD-1103843.1 | A-1929575.1 | 1852 | GAGUGAUCUAGGUGAUGCUAA | 897-917 | A-2051824.1 | 1911 | UUAGCAUCACCUAGAUCACUCCC | 895-917 |
| AD-1103844.1 | A-1930195.1 | 1853 | CAUGUCUUUAGAAACUGUCAA | 951-971 | A-2051825.1 | 1912 | UUGACAGUUUCUAAGACAUGGU | 949-971 |
| AD-1103845.1 | A-715471.1 | 1854 | UGUCUUUAGAAACUGUCAGAA | 256-276 | A-2051826.1 | 1913 | UUCUGACAGUUUCUAAAGACAUG | 254-276 |
| AD-1103846.1 | A-715711.1 | 1855 | UUUUAGCGGUUUGCAAACAAA | 386-406 | A-2051827.1 | 1914 | UUUGUUUGCAAACCGCUAAAAGU | 384-406 |
| AD-1103847.1 | A-1930694.1 | 1856 | GCGGUUUGCAAACAAAAUGAA | 1114-1134 | A-2051828.1 | 1915 | UUCAUUUUGUUUGCAAACCGCUA | 1112-1134 |
| AD-1103848.1 | A-1931044.1 | 1857 | GCAUUCAGCAAUUAAAGACAA | 1200-1220 | A-2051829.1 | 1916 | UUGUCUUUAAUUGCUGAAUGCCU | 1198-1220 |
| AD-414322.3 | A-714587.1 | 1858 | UCGACCAAAACUUAUUGGAGA | 476-496 | A-802900.1 | 1917 | UCUCCAAUAAGUUUUGGUCGAUG | 474-496 |

TABLE 14

Exemplary Human ATXN3 Lipid-Conjugated Sequences.
The C16 modifications shown are exemplary modifications.
It is understood other lipophilic moieties
may be used at other locations within the
duplex as provided above.

| Duplex Name | Modified sense strand sequence | SEQ ID NO | Modified antisense strand sequence | SEQ ID NO |
|---|---|---|---|---|
| AD-1040648 | asasacu(Ghd)UfcAfGfA faaugauuusgsa | 1925 | VPusCfsaaaUfcAfUfuuc uGfaCfaguuuscsu | 1983 |
| AD-1040649 | asascug(Uhd)CfaGfAfA faugauuugsasa | 1926 | VPusUfscaaAfuCfAfuuu cUfgAfcaguususc | 1984 |
| AD-1040650 | ascsugu(Chd)AfgAfAfA fugauuugasasa | 1927 | VPusUfsucaAfaUfCfauu uCfuGfacagususu | 1985 |
| AD-1040844 | usasgaa(Ahd)CfuGfUfC fagaaaugasusa | 1928 | VPusAfsucaUfuUfCfuga cAfgUfuucuasasa | 1986 |
| AD-1040907 | csasaag(Ahd)GfaUfGfA fggaaauaasgsa | 1929 | VPusCfsuuaUfuUfCfcuc aUfcUfcuuugsasc | 1987 |
| AD-1041117 | csgsguu(Uhd)GfcAfAfA fcaaaaugasusa | 1930 | VPusAfsucaUfuUfUfguu uGfcAfaaccgscsu | 1988 |
| AD-1041266 | gsasggc(Ahd)UfuCfAfG fcaauuaaasgsa | 1931 | VPusCfsuuuAfaUfUfgcu gAfaUfgccucsusu | 1989 |
| AD-1041321 | asgsgca(Uhd)UfcAfGfC faauuaaagsasa | 1932 | VPusUfscuuUfaAfUfugc uGfaAfugccuscsu | 1990 |
| AD-1041399 | ususuuu(Chd)UfuGfGfA fucuuuuugscsa | 1933 | VPusGfscaaAfaAfGfauc cAfaGfaaaaasusg | 1991 |
| AD-1041609 | gsgsguu(Uhd)CfaUfUfU fcuuauuaascsa | 1934 | VPusGfsuuaAfuAfAfgaa aUfgAfaagccsasc | 1992 |
| AD-1041668 | usasacc(Ahd)AfaUfUfA faccuuucasgsa | 1935 | VPusCfsugaAfaGfGfuua aUfuUfgguuasasu | 1993 |
| AD-1041823 | gscsucc(Ahd)GfuGfUfU fuucuugugsusa | 1936 | VPusAfscacAfaGfAfaaa cAfcUfggagcsasc | 1994 |
| AD-1041824 | csuscca(Ghd)UfgUfUfU fucuugugususa | 1937 | VPusAfsacaCfaAfGfaaa aCfaCfuggagscsa | 1995 |
| AD-1041837 | uscsucu(Ghd)AfuCfAfC faacuuuucsusa | 1938 | VPusAfsgaaAfaGfUfugu gAfuCfagagasasa | 1996 |
| AD-1041838 | csuscug(Ahd)UfcAfCfA facuuuucusgsa | 1939 | VPusCfsagaAfaAfGfuug uGfaUfcagagsasa | 1997 |
| AD-1041839 | uscsuga(Uhd)CfaCfAfA fcuuuucugscsa | 1940 | VPusGfscagAfaAfAfguu gUfgAfucagasgsa | 1998 |
| AD-1041850 | csusggu(Uhd)UfuCfAfU fuauuuccscsa | 1941 | VPusGfsggaAfaAfUfaau gAfaAfaccagsgsu | 1999 |
| AD-1041858 | ususuuc(Chd)CfaCfAfA fuucuuuugsasa | 1942 | VPusUfscaaAfaGfAfauu gUfgGfgaaaasusa | 2000 |
| AD-1041860 | ususucc(Chd)AfcAfAfU fucuuuugasasa | 1943 | VPusUfsucaAfaGfAfaau uGfuGfggaaasasu | 2001 |
| AD-1041940 | csusacc(Uhd)GfgUfUfU fucauuauususa | 1944 | VPusAfsaauAfaUfGfaaa aCfcCfagguagscsa | 2002 |
| AD-1041942 | ascscug(Ghd)UfuUfUfC fauuauuuuscsa | 1945 | VPusGfsaaaAfuAfAfuga aAfaCfcaggusasg | 2003 |
| AD-1041956 | csascaa(Uhd)UfcUfUfU fugaaagausgsa | 1946 | VPusCfsaucUfuUfCfaaa aGfaAfuugugsgsg | 2004 |
| AD-1041962 | ususuug(Ahd)AfaGfAfU fgguaaucususa | 1947 | VPusAfsagaUfuAfCfcau cUfuUfcaaaasgsa | 2005 |
| AD-1041966 | gsasaag(Ahd)UfgGfUfA | 1948 | VPusAfsgaaAfaGfAfuua | 2006 |

TABLE 14-continued

Exemplary Human ATXN3 Lipid-Conjugated Sequences.
The C16 modifications shown are exemplary modifications.
It is understood other lipophilic moieties
may be used at other locations within the
duplex as provided above.

| Duplex Name | Modified sense strand sequence | SEQ ID NO | Modified antisense strand sequence | SEQ ID NO |
|---|---|---|---|---|
| | faucuuuucsusa | | cCfaUfcuuucsasa | |
| AD-1042066 | ususccu(Ahd)AfaCfUfC fugaaaucasgsa | 1949 | VPusCfsugaUfuUfCfaga gUfuUfaggaascsg | 2007 |
| AD-1042138 | csasagu(Ahd)CfuUfGfA fgaauaaausgsa | 1950 | VPusCfsauuUfaUfUfcuc aAfgUfacuugsusg | 2008 |
| AD-1042150 | csusuuc(Chd)CfaGfAfU fgcuuuaugsasa | 1951 | VPusUfscauAfaAfGfcau cUfgGfgaaagscsa | 2009 |
| AD-1042171 | asasgua(Chd)UfuGfAfG faauaaaugsasa | 1952 | VPusUfscauUfuAfUfucu cAfaGfuacuusgsu | 2010 |
| AD-1042195 | ususucc(Chd)AfgAfUfG fcuuuaugasasa | 1953 | VPusUfsucaUfaAfAfgca uCfuGfggaaasgsc | 2011 |
| AD-1042315 | csasaaa(Chd)CfuUfAfC fagcuuugususa | 1954 | VPusAfsacaAfaGfCfugu aAfgGfuuuugsasu | 2012 |
| AD-1042316 | asasaac(Chd)UfuAfCfA fgcuuuguusgsa | 1955 | VPusCfsaacAfaAfGfcug uAfaGfguuuusgsa | 2013 |
| AD-1069819 | uscscau(Chd)UfuCfCfA fcgagaaacsasa | 1956 | VPusUfsguuUfcUfCfgug gAfaGfauggascsu | 2014 |
| AD-1069820 | csasucu(Uhd)CfcAfCfG fagaaacaasgsa | 1957 | VPusCfsuugUfuUfCfucg uGfgAfagaugsgsa | 2015 |
| AD-1069821 | asuscuu(Chd)CfaCfGfA fgaaacaagsasa | 1958 | VPusUfscuuGfuUfUfcuc gUfgGfaagausgsg | 2016 |
| AD-1069822 | csasgca(Ghd)CfcUfUfC fuggaaauasusa | 1959 | VPusAfsuauUfuCfCfaga aGfgCfugcugsusa | 2017 |
| AD-1069823 | asgsgaa(Ghd)GfuUfAfU fucuauauususa | 1960 | VPusAfsaauAfuAfGfaau aAfcCfuuccusgsu | 2018 |
| AD-1069824 | asuscga(Chd)CfaAfAfA fcuuauuggsasa | 1961 | VPusUfsccaAfuAfAfguu uUfgGfucgausgsc | 2019 |
| AD-1069825 | ascsgag(Ahd)AfgCfCfU facuuugaasasa | 1962 | VPusUfsuucAfaAfGfuag gCfuUfcucguscsu | 2020 |
| AD-1069826 | gsasgug(Ahd)UfcUfAfG fgugaugcusasa | 1963 | VPusUfsagcAfuCfAfccu aGfaUfcacucscsc | 2021 |
| AD-1069827 | csasugu(Chd)UfuUfAfG faaacugucsasa | 1964 | VPusUfsgacAfgUfUfucu aAfaGfacaugsgsu | 2022 |
| AD-1069828 | usgsucu(Uhd)UfaGfAfA facugucagsasa | 1965 | VPusUfscugAfcAfGfuuu cUfaAfagacasusg | 2023 |
| AD-1069829 | ususuua(Ghd)CfgGfUfU fugcaaacasasa | 1966 | VPusUfsuguUfuGfCfaaa cCfgCfuaaaasgsu | 2024 |
| AD-1069830 | gscsggu(Uhd)UfgCfAfA facaaaaugsasa | 1967 | VPusUfscauUfuUfGfuuu gCfaAfaccgcsusa | 2025 |
| AD-1069831 | gscsauu(Chd)AfgCfAfA fuuaaagacsasa | 1968 | VPusUfsgucUfuUfAfauu gCfuGfaaugcscsu | 2026 |
| AD-1069832 | uscsgac(Chd)AfaAfAfC fuuauuggasgsa | 1969 | VPusCfsuccAfaUfAfagu uUfuGfgucgasusg | 2027 |
| AD-1103836 | uscscau(Chd)UfuCfCfA fcgagaaacsasa | 1970 | VPusUfsguuUfcUfCfgug gAfaGfauggascsu | 2028 |
| AD-1103837 | csasucu(Uhd)CfcAfCfG fagaaacaasgsa | 1971 | VPusCfsuugUfuUfCfucg uGfgAfagaugsgsa | 2029 |

US 12,565,653 B2

217                                                                          218

TABLE 14-continued

Exemplary Human ATXN3 Lipid-Conjugated Sequences.
The C16 modifications shown are exemplary modifications.
It is understood other lipophilic moieties
may be used at other locations within the
duplex as provided above.

| Duplex Name | Modified sense strand sequence | SEQ ID NO | Modified antisense strand sequence | SEQ ID NO |
|---|---|---|---|---|
| AD-1103838 | asuscuu(Chd)CfaCfGfA fgaaacaagsasa | 1972 | VPusUfscuuGfuUfUfcuc gUfgGfaagausgsg | 2030 |
| AD-1103839 | csasgca(Ghd)CfcUfUfC fuggaaauasusa | 1973 | VPusAfsuauUfuCfCfaga aGfgCfugcugsusa | 2031 |
| AD-1103840 | asgsgaa(Ghd)GfuUfAfU fucuauauususa | 1974 | VPusAfsaauAfuAfGfaau aAfcCfuuccusgsu | 2032 |
| AD-1103841 | asuscga(Chd)CfaAfAfA fcuuauuggsasa | 1975 | VPusUfsccaAfuAfAfguu uUfgGfucgausgsc | 2033 |
| AD-1103842 | ascsgag(Ahd)AfgCfCfU facuuugaasasa | 1976 | VPusUfsuucAfaAfGfuag gCfuUfcucguscsu | 2034 |
| AD-1103843 | gsasgug(Ahd)UfcUfAfG fgugaugcusasa | 1977 | VPusUfsagcAfuCfAfccu aGfaUfcacucscsc | 2035 |
| AD-1103844 | csasugu(Chd)UfuUfAfG faaacugucsasa | 1978 | VPusUfsgacAfgUfUfucu aAfaGfacaugsgsu | 2036 |
| AD-1103845 | usgsucu(Uhd)UfaGfAfA facugucagsasa | 1979 | VPusUfscugAfcAfGfuuu cUfaAfagacasusg | 2037 |
| AD-1103846 | ususuua(Ghd)CfgGfUfU fugcaaacasasa | 1980 | VPusUfsuguUfuGfCfaaa cCfgCfuaaaasgsu | 2038 |
| AD-1103847 | gscsggu(Uhd)UfgCfAfA facaaaaugsasa | 1981 | VPusUfscauUfuUfGfuuu gCfaAfaccgcsusa | 2039 |
| AD-1103848 | gscsauu(Chd)AfgCfAfA fuuaaagacsasa | 1982 | VPusUfsgucUfuUfAfauu gCfuGfaaugcscsu | 2040 |

In Vitro Multi-Dose Screening of ATXN3 siRNAs in Hep3B and be(2)C Cells:

Cell Culture and Transfections:

Transfection experiments were performed in human hepatoma Hep3B cells (ATCC HB-8064) with EMEM (ATCC catalog no. 30-2003), and human neuroblastoma Be(2)-C cells (ATCC CRL-2268) with EMEM:F12 media (Gibco catalog no. 11765054) with EMEM media. Cells were transfected by adding 4.9 μL of Opti-MEM plus 0.1 μL of RNAiMAX per well (Invitrogen, Carlsbad CA cat #13778-150) to 5 μL of siRNA duplexes per well, with 4 replicates of each siRNA duplex, into a 384-well plate, and incubated at room temperature for 15 minutes. 40 μL of MEDIA containing ~5×10³ cells were then added to the siRNA mixture. Cells were incubated for 24 hours prior to RNA purification. Experiments were performed at 10 nM, 1 nM, and 0.1 nM final duplex concentrations in Hep3B cells and experiments were performed at 50 nm, 10 nM, 1 nM, and 0.1 nM final duplex concentrations in Be(2)-C cells.

Total RNA Isolation Using DYNABEADS mRNA Isolation Kit:

RNA was isolated using an automated protocol on a BioTek-EL406 platform using DYNABEADs (Invitrogen, cat #61012). Briefly, 70 μL of Lysis/Binding Buffer and 10 μL of lysis buffer containing 3 μL of magnetic beads were added to the plate with cells. Plates were incubated on an electromagnetic shaker for 10 minutes at room temperature and then magnetic beads were captured and the supernatant was removed. Bead-bound RNA was then washed 2 times with 150 μL Wash Buffer A and once with Wash Buffer B. Beads were then washed with 150 μL Elution Buffer, re-captured and supernatant removed.

cDNA Synthesis Using ABI High Capacity cDNA Reverse Transcription Kit (Applied Biosystems, Foster City, CA, Cat #4368813):

10 μL of a master mix containing 1 μL 10× Buffer, 0.4 μL 25×dNTPs, 1 μL 10× Random primers, 0.5 μL Reverse Transcriptase, 0.5 μL RNase inhibitor and 6.6 μL of H₂O per reaction was added to RNA isolated above. Plates were sealed, mixed, and incubated on an electromagnetic shaker for 10 minutes at room temperature, followed by 2h incubation at 37° C.

Real Time PCR:

2 μL of cDNA were added to a master mix containing 0.5 μL of human or mouse GAPDH TaqMan Probe (ThermoFisher cat 4352934E or 4351309) and 0.5 μL of appropriate ATXN3 probe (Thermo Fisher Taqman human Hs00268077, mouse: Mm00485946) and 5 μL Lightcycler 480 probe master mix (Roche Cat #04887301001) per well in a 384 well plates (Roche cat #04887301001). Real time PCR was done in a LightCycler480 Real Time PCR system (Roche). Each duplex was tested with N=4 and data were normalized to cells transfected with a non-targeting control siRNA. To calculate relative fold change, real time data were analyzed using the ΔΔCt method and normalized to assays performed with cells transfected with a non-targeting control siRNA.

Results

The results of the multi-dose screen in Hep3B cells transfected with the exemplary human ATXN3 siRNAs (correspond to siRNAs in Table 7A), are shown in Table 8. The experiments were performed at 10 nM, 1 nM, and 0.1 nM final duplex concentrations and the data are expressed as percent message remaining relative to a non-targeting control.

Of the exemplary siRNA duplexes evaluated at 10 nM in Table 8, 4 achieved ≥80% knockdown of ATXN3, 11 achieved ≥70% knockdown of ATXN3, 25 achieved ≥60% knockdown of ATXN3, 39 achieved ≥40% knockdown of ATXN3, and 51 achieved ≥20% knockdown of ATXN3.

Of the exemplary siRNA duplexes evaluated at 1 nM in Table 8, 2 achieved ≥70% knockdown of ATXN3, 8 achieved ≥60% knockdown of ATXN3, 17 achieved ≥50% knockdown of ATXN3, 25 achieved ≥40% knockdown of ATXN3, and 46 achieved ≥20% knockdown of ATXN3.

Of the exemplary siRNA duplexes evaluated at 0.1 nM in Table 8, 2 achieved ≥60% knockdown of ATXN3, 12 achieved ≥40% knockdown of ATXN3, 21 achieved ≥30% knockdown of ATXN3, 28 achieved ≥20% knockdown of ATXN3, and 37 achieved ≥10% knockdown of ATXN3.

TABLE 8

ATXN3 in vitro multi-dose screen in Hep3B cells with a set of exemplary ATXN3 siRNA duplexes. In this table, the column "Duplex Name" provides the numerical part of the duplex name, with a suffix (number following the decimal point in a duplex name) that merely refers to a batch production number. The suffix can be omitted from the duplex name without changing the chemical structure denoted.

| | 10 nM | | 1 nM | | 0.1 nM | |
|---|---|---|---|---|---|---|
| Duplex Concentration: Duplex | % of ATXN3 Message Remaining | ST Dev | % of ATXN3 Message Remaining | ST Dev | % of ATXN3 Message Remaining | ST Dev |
| AD-1069828.1 | 12.10 | 7.34 | 27.15 | 11.74 | 53.09 | 2.21 |
| AD-1069829.1 | 12.66 | 5.22 | 26.84 | 7.33 | 57.03 | 22.52 |
| AD-1069827.1 | 17.17 | 6.33 | 34.82 | 7.45 | 87.91 | 23.64 |
| AD-1040650.1 | 18.61 | 8.52 | 35.88 | 4.14 | 30.71 | 8.29 |
| AD-1103847.1 | 24.84 | 4.82 | 44.98 | 18.83 | 71.58 | 12.95 |
| AD-1069826.1 | 24.98 | 5.63 | 63.25 | 10.15 | 132.60 | 14.39 |
| AD-1069822.1 | 25.87 | 5.20 | 59.75 | 19.42 | 79.66 | 39.35 |
| AD-1069830.1 | 26.18 | 3.32 | 32.94 | 2.21 | 61.79 | 9.00 |
| AD-1041321.1 | 26.51 | 4.70 | 43.42 | 12.56 | 47.67 | 7.71 |
| AD-1103848.1 | 27.17 | 7.30 | 40.50 | 5.75 | 62.95 | 5.34 |
| AD-1040649.1 | 28.29 | 10.06 | 34.79 | 4.19 | 32.38 | 11.74 |
| AD-1041266.1 | 31.17 | 13.58 | 44.14 | 8.54 | 45.98 | 10.76 |
| AD-1069825.1 | 32.05 | 4.48 | 63.39 | 15.32 | 101.81 | 19.38 |
| AD-1069832.1 | 33.22 | 3.65 | 52.22 | 7.65 | 81.75 | 6.82 |
| AD-1069831.1 | 33.55 | 2.81 | 36.35 | 8.95 | 71.36 | 12.91 |
| AD-1040844.1 | 34.20 | 9.16 | 42.19 | 9.49 | 54.74 | 4.84 |
| AD-1040648.1 | 34.51 | 5.75 | 43.38 | 5.48 | 88.00 | 5.17 |
| AD-1103846.1 | 34.62 | 9.70 | 43.94 | 6.22 | 61.18 | 5.64 |
| AD-1042150.1 | 35.28 | 6.93 | 73.22 | 9.42 | 60.34 | 4.20 |
| AD-1041850.1 | 36.74 | 5.35 | 62.54 | 8.02 | 78.62 | 10.65 |
| AD-1041858.1 | 37.16 | 8.80 | 54.75 | 12.98 | 79.72 | 27.07 |
| AD-414322.3 | 38.14 | 7.83 | 61.05 | 12.37 | 79.11 | 12.60 |
| AD-1041117.1 | 38.98 | 14.47 | 41.28 | 10.16 | 55.09 | 12.09 |
| AD-1103840.1 | 39.57 | 5.28 | 38.17 | 5.21 | 55.04 | 9.04 |
| AD-1103843.1 | 39.89 | 9.38 | 52.39 | 20.09 | 74.06 | 12.54 |
| AD-1069823.1 | 40.51 | 4.13 | 44.77 | 7.72 | 62.16 | 13.97 |
| AD-1041609.1 | 40.81 | 3.94 | 59.62 | 26.25 | 52.37 | 11.37 |
| AD-1042195.1 | 43.51 | 3.84 | 56.15 | 12.15 | 59.20 | 15.73 |
| AD-1042171.1 | 43.78 | 14.84 | 60.54 | 9.77 | 54.70 | 10.18 |
| AD-1040907.1 | 48.86 | 6.70 | 63.75 | 9.82 | 62.00 | 6.85 |
| AD-1103844.1 | 49.58 | 14.44 | 77.23 | 19.44 | 92.66 | 4.87 |
| AD-1041942.1 | 50.01 | 2.66 | 60.20 | 7.65 | 61.99 | 9.25 |
| AD-1103841.1 | 50.32 | 4.27 | 87.59 | 19.30 | 97.04 | 25.62 |
| AD-1042138.1 | 50.99 | 8.52 | 55.29 | 17.15 | 68.53 | 7.55 |
| AD-1042066.1 | 51.12 | 2.62 | 74.01 | 10.93 | 85.95 | 2.25 |

TABLE 8-continued

ATXN3 in vitro multi-dose screen in Hep3B cells with a set of exemplary ATXN3 siRNA duplexes. In this table, the column "Duplex Name" provides the numerical part of the duplex name, with a suffix (number following the decimal point in a duplex name) that merely refers to a batch production number. The suffix can be omitted from the duplex name without changing the chemical structure denoted.

| | 10 nM | | 1 nM | | 0.1 nM | |
|---|---|---|---|---|---|---|
| Duplex Concentration: Duplex | % of ATXN3 Message Remaining | ST Dev | % of ATXN3 Message Remaining | ST Dev | % of ATXN3 Message Remaining | ST Dev |
| AD-1069824.1 | 51.21 | 4.30 | 52.89 | 1.65 | 67.54 | 3.76 |
| AD-1042315.1 | 57.00 | 5.94 | 64.86 | 2.97 | 84.92 | 15.76 |
| AD-1103836.1 | 57.17 | 2.66 | 88.56 | 23.08 | 105.01 | 6.38 |
| AD-1069820.1 | 57.55 | 8.62 | 85.06 | 8.89 | 111.64 | 8.46 |
| AD-1041837.1 | 63.48 | 9.05 | 72.93 | 5.18 | 88.19 | 10.36 |
| AD-1103839.1 | 64.38 | 5.79 | 75.64 | 7.53 | 111.12 | 14.15 |
| AD-1041841.1 | 65.64 | 19.11 | 74.75 | 11.89 | 82.96 | 26.48 |
| AD-1069819.1 | 66.77 | 12.06 | 79.25 | 10.21 | 106.49 | 7.36 |
| AD-1103838.1 | 67.32 | 11.56 | 73.26 | 8.04 | 111.95 | 16.38 |
| AD-1069821.1 | 67.75 | 13.26 | 86.63 | 3.30 | 99.15 | 33.90 |
| AD-1041399.1 | 69.00 | 3.81 | 90.14 | 7.18 | 84.57 | 11.93 |
| AD-1041940.1 | 70.29 | 15.24 | 80.68 | 8.64 | 83.71 | 5.19 |
| AD-1103845.1 | 74.79 | 7.36 | 72.53 | 4.68 | 111.63 | 10.49 |
| AD-1041823.1 | 75.76 | 3.86 | 88.52 | 10.08 | 100.31 | 3.83 |
| AD-1103842.1 | 77.41 | 18.86 | 77.58 | 23.25 | 119.74 | 32.98 |
| AD-1041956.1 | 79.72 | 9.70 | 63.37 | 10.86 | 95.11 | 6.62 |
| AD-1103837.1 | 82.82 | 5.84 | 89.94 | 10.62 | 122.40 | 9.34 |
| AD-1041962.1 | 82.95 | 19.71 | 66.91 | 10.39 | 114.04 | 28.63 |
| AD-1041838.1 | 87.67 | 11.15 | 85.08 | 5.02 | 135.30 | 9.08 |
| AD-1042316.1 | 98.70 | 40.59 | 85.69 | 11.19 | 124.45 | 13.48 |
| AD-1041824.1 | 99.68 | 31.22 | 75.04 | 9.04 | 119.43 | 7.83 |
| AD-1041860.1 | 108.58 | 8.01 | 81.74 | 2.70 | 120.39 | 22.46 |
| AD-1041668.1 | 117.27 | 6.50 | 131.92 | 3.21 | 128.75 | 16.10 |
| AD-1041966.1 | 132.85 | 49.34 | 98.56 | 13.22 | 126.07 | 3.82 |

The results of the multi-dose screen in Be(2)-C cells transfected with the exemplary human ATXN3 siRNAs (correspond to siRNAs in Table 7A), are shown in Table 9. The experiments were performed at 50 nM, 10 nM, 1 nM, and 0.1 nM final duplex concentrations and the data are expressed as percent message remaining relative to a non-targeting control.

Of the exemplary siRNA duplexes evaluated at 50 nM in Table 9, 1 achieved ≥80% knockdown of ATXN3, 11 achieved ≥70% knockdown of ATXN3, 19 achieved ≥60% knockdown of ATXN3, 30 achieved ≥50% knockdown of ATXN3, 36 achieved ≥40% knockdown of ATXN3, and 42 achieved ≥20% knockdown of ATXN3.

Of the exemplary siRNA duplexes evaluated at 10 nM in Table 9, 7 achieved ≥70% knockdown of ATXN3, 13 achieved ≥60% knockdown of ATXN3, 21 achieved ≥50% knockdown of ATXN3, 30 achieved ≥40% knockdown of ATXN3, and 42 achieved ≥20% knockdown of ATXN3.

Of the exemplary siRNA duplexes evaluated at 1 nM in Table 9, 2 achieved ≥70% knockdown of ATXN3, 7 achieved ≥60% knockdown of ATXN3, 10 achieved ≥50% knockdown of ATXN3, 16 achieved ≥40% knockdown of ATXN3, 24 achieved ≥30% knockdown of ATXN3, 29 achieved ≥20% knockdown of ATXN3, and 32 achieved ≥10% knockdown of ATXN3.

Of the exemplary siRNA duplexes evaluated at 0.1 nM in Table 9, 1 achieved ≥70% knockdown of ATXN3, 3 achieved ≥60% knockdown of ATXN3, 7 achieved ≥50% knockdown of ATXN3, 12 achieved ≥40% knockdown of ATXN3, 21 achieved ≥30% knockdown of ATXN3, 29 achieved ≥20% knockdown of ATXN3, and 32 achieved ≥10% knockdown of ATXN3.

TABLE 9

ATXN3 in vitro multi-dose screen in Be(2)-C cells with a set of exemplary ATXN3
siRNA duplexes. In this table, the column "Duplex Name" provides the numerical
part of the duplex name, with a suffix (number following the decimal point in
a duplex name) that merely refers to a batch production number. The suffix can
be omitted from the duplex name without changing the chemical structure denoted.

| | 50 nM | | 10 nM | | 1 nM | | 0.1 nM | |
| | % of ATXN3 Message Remaining | SD | % of ATXN3 Message Remaining | SD | % of ATXN3 Message Remaining | SD | % of ATXN3 Message Remaining | SD |
| Duplex | | | | | | | | |
|---|---|---|---|---|---|---|---|---|
| AD-1103843.1 | 20.89 | 3.00 | 21.47 | 1.65 | 30.76 | 4.79 | 47.20 | 5.99 |
| AD-1103847.1 | 25.14 | 8.53 | 24.85 | 1.30 | 37.53 | 9.60 | 49.53 | 14.57 |
| AD-1103846.1 | 27.80 | 3.43 | 26.06 | 2.46 | 37.65 | 11.39 | 38.99 | 4.12 |
| AD-1103848.1 | 33.41 | 7.90 | 26.94 | 5.81 | 52.74 | 27.35 | 51.41 | 17.14 |
| AD-1069830.1 | 27.66 | 7.18 | 27.62 | 6.26 | 23.83 | 2.65 | 50.68 | 16.14 |
| AD-1103844.1 | 27.26 | 4.33 | 29.69 | 5.66 | 50.55 | 12.46 | 59.41 | 4.92 |
| AD-1069829.1 | 19.06 | 2.82 | 29.74 | 5.06 | 40.65 | 12.79 | 28.67 | 3.95 |
| AD-1041266.1 | 32.71 | 4.46 | 32.19 | 10.25 | 40.69 | 11.90 | 50.40 | 19.96 |
| AD-414322.3 | 105.75 | 67.48 | 35.40 | 11.97 | 106.60 | 53.83 | 72.20 | 23.48 |
| AD-1069823.1 | 28.57 | 6.23 | 35.82 | 10.41 | 27.47 | 4.83 | 39.33 | 7.84 |
| AD-1069828.1 | 23.46 | 3.14 | 38.39 | 3.79 | 55.34 | 9.92 | 47.51 | 6.98 |
| AD-1040649.1 | 32.10 | 5.10 | 39.44 | 13.29 | 61.22 | 18.48 | 85.46 | 4.88 |
| AD-1040844.1 | 29.60 | 8.19 | 39.79 | 5.51 | 50.66 | 8.11 | 75.10 | 16.00 |
| AD-1040648.1 | 34.47 | 6.93 | 41.90 | 8.10 | 61.21 | 13.46 | 106.20 | 26.77 |
| AD-1103845.1 | 40.27 | 7.26 | 43.47 | 1.24 | 62.12 | 8.64 | 68.61 | 9.92 |
| AD-1103840.1 | 52.97 | 20.89 | 43.57 | 6.87 | 72.23 | 25.29 | 97.14 | 7.36 |
| AD-1069822.1 | 24.76 | 2.28 | 44.72 | 10.05 | 61.74 | 9.60 | 46.46 | 6.06 |
| AD-1040650.1 | 33.70 | 3.55 | 46.19 | 10.37 | 61.41 | 10.26 | 103.08 | 21.14 |
| AD-1069831.1 | 42.18 | 6.53 | 47.37 | 3.69 | 30.54 | 7.58 | 64.49 | 10.84 |
| AD-1041117.1 | 32.01 | 1.75 | 49.15 | 9.12 | 54.68 | 4.67 | 75.30 | 14.35 |
| AD-1069826.1 | 29.03 | 5.91 | 49.93 | 7.24 | 66.33 | 13.40 | 70.39 | 5.57 |
| AD-1103838.1 | 50.32 | 9.94 | 50.93 | 11.69 | 74.46 | 21.04 | 95.97 | 12.89 |
| AD-1041321.1 | 40.75 | 8.69 | 52.74 | 14.41 | 74.07 | 19.24 | 87.11 | 14.32 |
| AD-1103839.1 | 61.67 | 9.12 | 53.59 | 8.34 | 89.71 | 19.51 | 120.69 | 19.94 |
| AD-1069824.1 | 47.67 | 23.28 | 54.44 | 4.60 | 43.41 | 4.08 | 61.18 | 10.48 |
| AD-1040907.1 | 48.57 | 7.01 | 55.23 | 5.69 | 65.10 | 9.49 | 89.62 | 10.40 |
| AD-1069832.1 | 46.54 | 8.57 | 55.32 | 3.55 | 38.68 | 5.53 | 68.35 | 2.97 |
| AD-1103841.1 | 147.74 | 69.39 | 55.99 | 19.11 | 164.19 | 67.96 | 122.38 | 13.70 |
| AD-1103836.1 | 48.46 | 7.53 | 58.44 | 9.07 | 86.20 | 20.50 | 77.73 | 8.58 |
| AD-1069827.1 | 42.74 | 32.20 | 59.85 | 7.15 | 105.45 | 79.49 | 63.83 | 4.18 |
| AD-1041956.1 | 41.45 | 2.42 | 63.87 | 24.98 | 56.06 | 6.57 | 58.42 | 11.70 |
| AD-1103837.1 | 52.63 | 9.25 | 65.14 | 12.96 | 83.08 | 25.60 | 91.86 | 21.39 |
| AD-1041824.1 | 54.86 | 38.77 | 66.52 | 28.79 | 78.97 | 26.01 | 74.91 | 10.73 |
| AD-1069820.1 | 38.69 | 6.51 | 66.89 | 16.45 | 120.61 | 15.23 | 66.02 | 2.81 |
| AD-1069819.1 | 35.78 | 1.37 | 67.86 | 9.53 | 99.75 | 23.11 | 64.20 | 2.30 |
| AD-1069825.1 | 43.47 | 4.98 | 68.38 | 13.28 | 100.79 | 57.66 | 70.73 | 2.01 |
| AD-1041962.1 | 50.57 | 9.24 | 68.42 | 28.74 | 69.04 | 20.43 | 61.29 | 16.22 |
| AD-1069821.1 | 42.76 | 3.25 | 69.70 | 5.16 | 125.94 | 11.08 | 64.08 | 4.79 |
| AD-1041609.1 | 62.43 | 28.22 | 70.76 | 33.33 | 100.21 | 54.54 | 92.29 | 24.16 |
| AD-1042316.1 | 56.02 | 27.29 | 73.28 | 30.24 | 73.64 | 27.64 | 73.93 | 16.05 |
| AD-1041850.1 | 65.10 | 2.50 | 77.82 | 42.55 | 96.34 | 41.58 | 108.00 | 43.96 |
| AD-1041858.1 | 61.13 | 5.07 | 78.34 | 36.64 | 101.62 | 60.26 | 97.51 | 41.03 |
| AD-1041399.1 | 76.37 | 7.46 | 85.46 | 41.25 | 100.35 | 45.16 | 116.57 | 29.80 |
| AD-1041966.1 | 65.74 | 8.30 | 85.68 | 20.63 | 100.13 | 23.09 | 96.42 | 21.74 |
| AD-1041837.1 | 85.09 | 17.03 | 85.77 | 27.23 | 124.89 | 39.63 | 103.34 | 11.98 |
| AD-1042195.1 | 119.26 | 67.12 | 85.87 | 34.98 | 121.51 | 55.10 | 121.72 | 44.48 |
| AD-1042315.1 | 105.55 | 45.20 | 88.06 | 17.63 | 133.66 | 40.81 | 132.37 | 31.28 |
| AD-1041839.1 | 112.51 | 20.51 | 89.72 | 22.82 | 141.97 | 44.71 | 147.34 | 32.04 |
| AD-1042066.1 | 95.46 | 48.74 | 89.88 | 35.54 | 112.04 | 39.72 | 109.40 | 31.64 |
| AD-1103842.1 | 231.85 | 313.46 | 92.19 | 57.75 | 94.48 | 66.89 | 93.05 | 24.06 |
| AD-1041942.1 | 106.25 | 38.85 | 93.78 | 28.29 | 127.73 | 36.25 | 157.28 | 49.53 |
| AD-1042171.1 | 84.86 | 28.41 | 94.57 | 28.38 | 111.96 | 36.92 | 136.60 | 22.38 |
| AD-1041940.1 | 90.27 | 32.84 | 97.94 | 31.36 | 127.29 | 45.70 | 137.32 | 33.24 |
| AD-1042138.1 | 102.10 | 61.73 | 99.18 | 36.11 | 125.21 | 51.79 | 106.92 | 26.85 |
| AD-1042150.1 | 96.91 | 40.13 | 101.44 | 29.83 | 126.04 | 34.58 | 169.91 | 29.39 |
| AD-1041838.1 | 90.46 | 28.29 | 102.26 | 29.51 | 110.73 | 31.66 | 116.81 | 25.42 |
| AD-1041860.1 | 102.48 | 46.46 | 106.52 | 38.43 | 111.94 | 33.85 | 124.43 | 35.31 |
| AD-1041823.1 | 95.80 | 41.04 | 113.59 | 42.50 | 102.03 | 8.49 | 130.31 | 42.17 |
| AD-1041668.1 | 152.46 | 30.75 | 121.29 | 31.57 | 176.89 | 44.98 | 161.49 | 8.15 |

SEQUENCES
LOCUS NM_ 001127697 6770 bp mRNA linear PRI 19 MAR. 2019
DEFINITION *Homo sapiens* ataxin 3 (ATXN3), transcript variant e, mRNA.

-continued

VERSION NM_001127697.2

SEQ ID NO: 1

```
   1 gagaggggca gggggcggag ctggaggggg tggttcggcg tggggccgt tggctccaga 61 caaataaaca tggagtccat cttccacgag aaacaagaag gctcactttg tgctcaacat 121 tgcctgaata acttattgca aggagaatat tttagccctg tggaattatc ctcaattgca 181 catcagctgg atgaggagga gaggatgaga atggcagaag gaggagttac tagtgaagat 241 tatcgcacgt ttttacagca gccttctgga aatatggatg acagtggttt tttctctatt 301 cagtggttta acttgaattc tctcttgacg ggtccagaat aatatcaga tacatatctt 361 gcacttttct tggctcaatt acaacaggaa ggttattcta tatttgtcgt taagggtgat 421 ctgccagatt gcgaagctga ccaactcctg cagatgatta gggtccaaca gatgcatcga 481 ccaaaactta ttggagaaga attagcacaa ctaaaagagc aaagagtcca taaaacagac 541 ctggaacgag tgttagaagc aaatgatggc tcaggaatgt tagacgaaga tgaggaggat 601 ttgcagaggg ctctggcact aagtcgccaa gaaattgaca tggaagatga ggaagcagat 661 ctccgcaggg ctattcagct aagtatgcaa ggtagttcca gaaacatatc tcaagatatg 721 acacagacat caggtacaaa tcttacttca gaagagcttc ggaagagacg agaagcctac 781 tttgaaaaac agcagcaaaa gcagcaacag cagcagcagc agcagcagca gggggaccta 841 tcaggacaga gttcacatcc atgtgaaagg ccagccacca gttcaggagc acttgggagt 901 gatctaggtg atgctatgag tgaagaagac atgcttcagg cagctgtgac catgtcttta 961 gaaactgtca gaaatgattt gaaaacagaa ggaaaaaaat aataccttta aaaaataatt 1021 tagatattca tactttccaa cattatcctg tgtgattaca gcatagggtc cactttggta 1081 atgtgtcaaa gagatgagga aataagactt ttagcggttt gcaaacaaaa tgatgggaaa 1141 gtggaacaat gcgtcggttg taggactaaa taatgatctt ccaaatatta gccaaagagg 1201 cattcagcaa ttaaagacat ttaaaatagt tttctaaatg tttcttttc ttttttgagt 1261 gtgcaatatg taacatgtct aaagttaggg cattttcctt ggatctttt gcagactagc 1321 taattagctc tcgcctcagg cttttttccat atagtttgtt ttcttttct gtcttgtagg 1381 taagttggct cacatcatgt aatagtggct ttcatttctt attaaccaaa ttaacctttc 1441 aggaaagtat ctctactttc ctgatgttga taatagtaat ggttctagaa ggatgaacag 1501 ttctcccttc aactgtatac cgtgtgctcc agtgttttct tgtgttgttt tctctgatca 1561 caacttttct gctacctggt tttcattatt ttcccacaat tcttttgaaa gatggtaatc 1621 ttttctgagg tttagcgttt taagccctac gatgggatca ttatttcatg actggtgcgt 1681 tcctaaactc tgaaatcagc cttgcacaag tacttgagaa taaatgagca ttttttaaaa 1741 tgtgtgagca tgtgctttcc cagatgcttt atgaatgtct tttcacttat atcaaaacct 1801 tacagctttg ttgcaacccc ttcttcctgc gccttatttt ttcctttctt ctccaattga 1861 gaaaactagg agaagcatag tatgcaggca agtctccttc tgttagaaga ctaaacatac 1921 gtacccacca tgaatgtatg atacatgaaa tttggccttc aattttaata gcagtttat 1981 tttattttt ctcctatgac tggagctttg tgttctcttt acagttgagt catggaatgt 2041 aggtgtctgc ttcacatctt ttagtaggta tagcttgtca aagatggtga tctggaacat 2101 gaaaataatt tactaatgaa aatatgttta aatttatact gtgatttgac acttgcatca 2161 tgtttagata gcttaagaac aatggaagtc acagtactta gtggatctat aaataagaaa 2221 gtccatagtt ttgataaata ttctctttaa ttgagatgta cagagagttt cttgctgggt 2281 caataggata gtatcatttt ggtgaaaacc atgtctctga aattgatgtt ttagtttcag 2341 tgttccctat ccctcattct ccatctcctt ttgaagctct tttgaatgtt gaattgttca
```

-continued

```
2401 taagctaaaa tccaagaaat ttcagctgac aacttcgaaa attataatat ggtatattgc 2461 cctcctggtg tgtggctgca cacattttat cagggaaagt tttttgatct aggatttatt 2521 gctaactaac tgaaaagaga agaaaaaata tcttttattt atgattataa aatagctttt 2581 tcttcgatat aacagatttt ttaagtcatt attttgtgcc aatcagtttt ctgaagtttc 2641 ccttacacaa aaggatagct ttattttaaa atctaaagtt tcttttaata gttaaaaatg 2701 tttcagaaga attataaaac tttaaaactg caagggatgt tggagtttag tactactccc 2761 tcaagattta aaaagctaaa tattttaaga ctgaacattt atgttaatta ttaccagtgt 2821 gtttgtcata ttttccatgg atatttgttc attacctttt tccattgaaa agttacatta 2881 aacttttcat acacttgaat tgatgagcta cctaatataa aaatgagaaa accaatatgc 2941 attttaaagt tttaacttta gagttttataa agttcatata taccctagtt aaagcactta 3001 agaaaatatg gcatgtttga cttttagttc ctagagagtt tttgtttttg tttttgtttt 3061 tttttgagac ggagtcttgc tatgtctccc aggctggagg gcagtggcat gatctcggct 3121 cactacaact tccacctccc gggttcaagc aattctcctg cctcagcctc cagagtagct 3181 gggattacag gcgcccacca ccacacccgg cagatttttg tattttttggt agagacgcgg 3241 tttcatcatg tttggccagg ctggtctcga actcctgacc tcaggtgatc cgcctgcctt 3301 ggcctcccaa agtgttggga ttacaggcat gagccactgc gcctggccag ctagagagtt 3361 tttaaagcag agctgagcac acactggatg cgtttgaatg tgtttgtgta gtttgttgtg 3421 aaattgttac atttagcagg cagatccaga agcactagtg aactgtcatc ttggtggggt 3481 tggcttaaat ttaattgact gtttagattc catttcttaa ttgattggcc agtatgaaaa 3541 gatgccagtg caagtaacca tagtatcaaa aaagttaaaa attattcaaa gctatagttt 3601 atacatcagg tactgccatt tactgtaaac cacctgcaag aaagtcagga acaactaaat 3661 tcacaagaac tgtcctgcta agaagtgtat taaagatttc cattttgttt tactaattgg 3721 gaacatctta atgtttaata tttaaactat tggtatcatt tttctaatgt ataatttgta 3781 ttactgggat caagtatgta cagtggtgat gctagtagaa gtttaagcct tggaaatacc 3841 actttcatat tttcagatgt catggattta atgagtaatt tatgttttta aaattcagaa 3901 tagttaatct ctgatctaaa accatcaatc tatgtttttt acggtaatca tgtaaatatt 3961 tcagtaatat aaactgtttg aaaaggctgc tgcaggtaaa ctctatacta ggatcttggc 4021 caaataattt acaattcaca gaatatttta tttaaggtgg tgcttttttt ttttgtcctt 4081 aaaacttgat ttttcttaac tttattcatg atgccaaagt aaatgaggaa aaaaactcaa 4141 aaccagttga gtatcattgc agacaaaact accagtagtc catattgttt aatattaagt 4201 tgaataaaat aaattttatt tcagtcagag cctaaatcac attttgattg tctgaatttt 4261 tgatactatt tttaaaatca tgctagtggc ggctgggcgt ggtagctcac gcctgtaatc 4321 ccagcatttt gggaggccga agtgggtgga tcacgaggtc gggagttcga gaccagcttg 4381 gccaaaatgg tgaaaccccca tctgtactaa aaactacaaa aattagctgg gcgcggtggc 4441 aggtgcctgt aatcccagct acctgggagt ctgaggcagg agaattgctt gaaccctggc 4501 gacagaggat gcagtgagcc aagatggtgc cactgtactc cagactgggc gacagagtga 4561 gactctgtct caaaaaaaaa aaaaaaatca tgctagtgcc aagagctact aaattcttaa 4621 aaccggccca ttggacctgt acagataaaa aatagattca gtgcataatc aaaatatgat 4681 aattttaaaa tcttaagtag aaaaataaat cttgatgttt taaattctta cgaggattca 4741 atagttaata ttgatgatct cccggctggg tgcagtggct cacgcctgta atcccagcag
```

-continued

```
4801 ttctggaggc tgaggtgggc gaatcacttc aggccaggag ttcaagacca gtctgggcaa 4861 catggtgaaa cctcgtttct actaaaaata caaaaattag ccgggcgtgg ttgcacacac 4921 ttgtaatccc agctactcag gaggctaaga atcgcatgag cctaggaggc agaggttgca 4981 gagtgccaag ggctcaccac tgcattccag cctgcccaac agagtgagac actgtttctg 5041 aaaaaaaaaa atatatatat atatatatat atgtgtgtat atatatatgt atatatatat 5101 gacttcctat taaaaacttt atcccagtcg ggggcagtgg ctcacgcctg taatcccaac 5161 actttgggag gctgaggcag gtggatcacc tgaagtccgg agtttgagac cagcctggcc 5221 aacatggtga aaccccatct ctactaaaaa tacaaaactt aagccaggta tggtggcggg 5281 cacctgtaat cccagttact tgggaggctg aggcaggaga atcgtttaaa cccaggaggt 5341 ggaggttgca gtgagctgag atcgtgccat tgcactctag cctgggcaac aagagtaaaa 5401 ctccatctta aaggtttgtt tgtttttttt taatccggaa acgaagaggc gttgggccgc 5461 tattttcttt ttctttcttt ctttcttttct ttttttttttt ttctgagacg gagtctagct 5521 ctgctgccca ggctggagta caatgacacg atgttggctc actgcaacct ccacctcctg 5581 ggttcaagcg attctcctgc ctcagcctcc caagtacctg ggattacagg cacctgccac 5641 tacacctggc gaatatttgt tttttttagt agagacgggc ttttaccatg ttaggctggt 5701 ctcaaactcc tgacctcagg tgatctgcct gccttggcct cccaaagtgc tgggattaca 5761 ggtgcaggcc accacacccg gccttgggcc actgttttca aagtgaattg tttgttgtat 5821 cgagtcctta agtatggata tatatgtgac cctaattaag aactaccaga ttggatcaac 5881 taatcatgtc agcaatgtaa ataactttat ttttcatatt caaaataaaa acttcttttt 5941 atttctggcc cctttataac cagcatcttt ttgctttaaa aaatgacctg gctttgtatt 6001 tttttagtct taaacataat aaaaatattt ttgttctaat ttgctttcat gagtgaagat 6061 tattgacatc gttggtaaat tctagaattt tgattttgtt ttttaatttg aagaaaatct 6121 ttgctattat tattttttcc aagtggtctg gcattttaag aattagtgct aataacgtaa 6181 cttctaaatt tgtcgtaatt ggcatgttta atagcatatc aaaaaacatt ttaagcctgt 6241 ggattcatag acaaagcaat gagaaacatt agtaaaatat aaatggatat tcctgatgca 6301 tttaggaagc tctcaattgt ctcttgcata gttcaaggaa tgttttctga attttttttaa 6361 tgcttttttt tttttttgaaa gaggaaaaca tacatttttta aatgtgatta tctaattttt 6421 acaacactgg gctattagga ataacttttt aaaaattact gttctgtata aatatttgaa 6481 attcaagtac agaaaatatc tgaaacaaaa agcattgttg tttggccatg atacaagtgc 6541 actgtggcag tgccgcttgc tcaggaccca gccctgcagc ccttctgtgt gtgctccctc 6601 gttaagttca tttgctgtta ttacacacac aggccttcct gtctggtcgt tagaaaagcc 6661 gggcttccaa agcactgttg aacacaggat tctgttgtta gtgtggatgt tcaatgagtt 6721 gtattttaaa tatcaaagat tattaaataa agataatgtt tgctttttcta
```

Reverse complement of SEQ ID NO: 1

SEQ ID NO: 2

```
tagaaaagcaaacattatctttatttaataatctttgatatttaaaatacaactcattgaacatccacact aacaacagaatcctgtgttcaacagtgctttggaagcccggcttttctaacgaccagacaggaaggcctgt gtgtgtaataacagcaaatgaacttaacgagggagcacacacagaagggctgcagggctgggtcctgagca agcggcactgccacagtgcacttgtatcatggccaaacaacaatgctttttgtttcagatattttctgtac ttgaatttcaaatatttatacagaacagtaatttttaaaaagttattcctaatagcccagtgttgtaaaaa ttagataatcacatttaaaaatgtatgttttcctctttcaaaaaaaaaaaaagcattaaaaaaattcagaa aacattccttgaactatgcaagagacaattgagagcttcctaaatgcatcaggaatatccatttatatttt
```

-continued actaatgtttctcattgctttgtctatgaatccacaggcttaaaatgttttttgatatgctattaaacatg ccaattacgacaaatttagaagttacgttattagcactaattcttaaaatgccagaccacttggaaaaaat aataatagcaaagattttcttcaaattaaaaaacaaaatcaaaattctagaatttaccaacgatgtcaata atcttcactcatgaaagcaaattagaacaaaaatattttattatgtttaagactaaaaaaatacaaagcc aggtcatttttaaagcaaaaagatgctggttataaaggggccagaaataaaagaaagtttttattttgaa tatgaaaaataaagttatttacattgctgacatgattagttgatccaatctggtagttcttaattagggtc acatatatatccatacttaaggactcgatacaacaaacaattcactttgaaaacagtggcccaaggccggg tgtggtggcctgcacctgtaatcccagcactttgggaggccaaggcaggcagatcacctgaggtcaggagt ttgagaccagcctaacatggtaaaagcccgtctctactaaaaaaaacaaatattcgccaggtgtagtggca ggtgcctgtaatcccaggtacttgggaggctgaggcaggagaatcgcttgaacccaggaggtggaggttgc agtgagccaacatcgtgtcattgtactccagcctgggcagcagagctagactccgtctcagaaaaaaaaa aaagaaagaaagaaagaaagaaaaagaaatagcggcccaacgcctcttcgtttccggattaaaaaaaaac aaacaaacctttaagatggagttttactcttgttgcccaggctagagtgcaatggcacgatctcagctcac tgcaacctccacctcctgggtttaaacgattctcctgcctcagcctcccaagtaactgggattacaggtgc ccgccaccatacctggcttaagttttgtattttttagtagagatggggtttcaccatgttggccaggctggt ctcaaactccggacttcaggtgatccacctgcctcagcctcccaaagtgttgggattacaggcgtgagcca ctgcccccgactgggataaagtttttaataggaagtcatatatatatacatatatatatacacacatatat atatatatatatattttttttttttcagaaacagtgtctcactctgttgggcaggctggaatgcagtggt gagcccttggcactctgcaacctctgcctcctaggctcatgcgattcttagcctcctgagtagctgggatt acaagtgtgtgcaaccacgcccggctaatttttgtattttttagtagaaacgaggtttcaccatgttgccca gactggtcttgaactcctggcctgaagtgattcgcccacctcagcctccagaactgctgggattacaggcg tgagccactgcacccagccgggagatcatcaatattaactattgaatcctcgtaagaatttaaaacatcaa gatttattttctacttaagattttaaaattatcatattttgattatgcactgaatctatttttttatctgt acaggtccaatgggccggttttaagaatttagtagctcttggcactagcatgatttttttttttttttttga gacagagtctcactctgtcgcccagtctggagtacagtggcaccatcttggctcactgcatcctctgtcgc cagggttcaagcaattctcctgcctcagactcccaggtagctgggattacaggcacctgccaccgcgccca gctaattttttgtagttttttagtacagatggggtttcaccattttggccaagctggtctcgaactcccgacc tcgtgatccacccacttcggcctcccaaaatgctgggattacaggcgtgagctaccacgcccagccgccac tagcatgattttaaaaatagtatcaaaaattcagacaatcaaaatgtgatttaggctctgactgaaataaa atttattttattcaacttaatattaaacaatatggactactggtagttttgtctgcaatgatactcaactg gttttgagtttttttcctcatttactttggcatcatgaataaagttaagaaaaatcaagttttaaggacaa aaaaaaaagcaccaccttaaataaaatattctgtgaattgtaaattatttggccaagatcctagtataga gtttacctgcagcagccttttcaaacagtttatattactgaaatatttacatgattaccgtaaaaaacata gattgatggttttagatcagagattaactattctgaattttaaaaacataaattactcattaaatccatga catctgaaaatatgaaagtggtatttccaaggcttaaacttctactagcatcaccactgtacatacttgat cccagtaatacaaattatacattagaaaaatgataccaatagtttaaatattaaacattaagatgttccca attagtaaaacaaaatggaaatctttaatacacttcttagcaggacagttcttgtgaatttagttgttcct gactttcttgcaggtggtttacagtaaatggcagtacctgatgtataaactatagctttgaataatttta acttttttgatactatggttacttgcactggcatcttttcatactggccaatcaattaagaaatggaatct aaacagtcaattaaatttaagccaaccccaccaagatgacagttcactagtgcttctggatctgcctgcta -continued

```
aatgtaacaatttcacaacaaactacacaaacacattcaaacgcatccagtgtgtgctcagctctgcttta aaaactctctagctggccaggcgcagtggctcatgcctgtaatcccaacactttgggaggccaaggcaggc ggatcacctgaggtcaggagttcgagaccagcctggccaaacatgatgaaaccgcgtctctaccaaaaata caaaaatctgccgggtgtggtggtgggcgcctgtaatcccagctactctggaggctgaggcaggagaattg cttgaacccgggaggtggaagttgtagtgagccgagatcatgccactgccctccagcctgggagacatagc aagactccgtctcaaaaaaaaacaaaaacaaaaacaaaaactctctaggaactaaaagtcaaacatgccat attttcttaagtgctttaactagggtatatatgaactttatatatctaaagttaaaactttaaaatgcat attggttttctcattttatattaggtagctcatcaattcaagtgtatgaaaagtttaatgtaacttttca atggaaaaggtaatgaacaaatatccatggaaaatatgacaaacacactggtaataattaacataaatgt tcagtcttaaaatatttagctttttaaatcttgagggagtagtactaaactccaacatcccttgcagtttt aaagttttataattcttctgaaacattttttaactattaaaagaaactttagattttaaaataaagctatcc ttttgtgtaagggaaacttcagaaaactgattggcacaaaataatgacttaaaaaatctgttatatcgaag aaaaagctattttataatcataaataaaagatattttttcttctcttttcagttagttagcaataaatcct agatcaaaaaactttccctgataaaatgtgtgcagccacacaccaggagggcaatataccatattataatt ttcgaagttgtcagctgaaatttcttggattttagcttatgaacaattcaacattcaaaagagcttcaaaa ggagatggagaatgagggatagggaacactgaaactaaaacatcaatttcagagacatggttttcaccaaa atgatactatcctattgacccagcaagaaactctctgtacatctcaattaaagagaatatttatcaaaact atggactttcttatttatagatccactaagtactgtgacttccattgttcttaagctatctaaacatgatg caagtgtcaaatcacagtataaatttaaacatattttcattagtaaattattttcatgttccagatcacca tctttgacaagctatacctactaaaagatgtgaagcagacacctacattccatgactcaactgtaaagaga acacaaagctccagtcataggagaaaaaataaaataaaactgctattaaaattgaaggccaaatttcatgt atcatacattcatggtgggtacgtatgtttagtcttctaacagaaggagacttgcctgcatactatgcttc tcctagtttttctcaattggagaagaaaggaaaaaataaggcgcaggaagaaggggttgcaacaaagctgta aggttttgatataagtgaaaagacattcataaagcatctgggaaagcacatgctcacacatttaaaaaat gctcatttattctcaagtacttgtgcaaggctgatttcagagtttaggaacgcaccagtcatgaaataatg atcccatcgtagggcttaaaacgctaaacctcagaaaagattaccatctttcaaaagaattgtgggaaaat aatgaaaaccaggtagcagaaaagttgtgatcagagaaaacaacacaagaaaacactggagcacacggtat acagttgaagggagaactgttcatccttctagaaccattactattatcaacatcaggaaagtagagatact ttcctgaaaggttaatttggttaataagaaatgaaagccactattacatgatgtgagccaacttacctaca agacagaaaagaaacaaactatatggaaaaagcctgaggcgagagctaattagctagtctgcaaaaaga tccaagaaaatgccctaactttagacatgttacatattgcacactcaaaaaagaaaaagaaacatttaga aaactattttaaatgtctttaattgctgaatgcctctttggctaatatttggaagatcattatttagtcct acaaccgacgcattgttccactttcccatcattttgtttgcaaaccgctaaaagtcttatttcctcatctc tttgacacattaccaaagtggaccctatgctgtaatcacacaggataatgttggaaagtatgaatatctaa attattttttaaaggtattattttttttccttctgttttcaaatcatttctgacagtttctaaagacatggt cacagctgcctgaagcatgtcttcttcactcatagcatcacctagatcactcccaagtgctcctgaactgg tggctggcctttcacatggatgtgaactctgtcctgataggtcccctgctgctgctgctgctgctgctgt tgctgcttttgctgctgttttttcaaagtaggcttctcgtctcttccgaagctcttctgaagtaagatttgt acctgatgtctgtgtcatatcttgagatatgtttctggaactaccttgcatacttagctgaatagccctgc ggagatctgcttcctcatcttccatgtcaatttcttggcgacttagtgccagagccctctgcaaatcctcc tcatcttcgtctaacattcctgagccatcatttgcttctaacactcgttccaggtctgtttttatggactct
```

-continued ttgctcttttagttgtgctaattcttctccaataagtttttggtcgatgcatctgttggaccctaatcatct gcaggagttggtcagcttcgcaatctggcagatcacccttaacgacaaatatagaataaccttcctgttgt aattgagccaagaaaagtgcaagatatgtatctgatattaattctggacccgtcaagagagaattcaagtt aaaccactgaatagagaaaaaaccactgtcatccatatttccagaaggctgctgtaaaaacgtgcgataat cttcactagtaactcctccttctgccattctcatcctctcctcctcatccagctgatgtgcaattgaggat aattccacagggctaaaatattctccttgcaataagttattcaggcaatgttgagcacaaagtgagccttc ttgtttctcgtggaagatggactccatgtttatttgtctggagccaacggcccccacgccgaaccacccc tccagctccgcccccctgccctctc LOCUS XM_005595835 1987 bpmRNAlinear PRI 19 SEP. 2013
DEFINITION PREDICTED: *Macaca fascicularis* ataxin 3 (ATXN3),
transcript variant XI, mRNA.
VERSION XM_005595835.1

SEQ ID NO: 3

```
   1 ggggtggttc ggtgtggggg ccgttggctc cagacaaata aacatggagt ccatcttcca 61 cgagaaacaa gaaggctcac tttgtgctca acattgcctg aataatttat tgcaaggaga 121 atattttagc cctgtggaat tatcctcaat tgcacatcag ctggatgagg aggagaggat 181 gagaatggca gaaggaggag ttactagtga agattatcgc acgtttttac agcagccttc 241 tggaaatatg gatgacagtg gttttttctc tattcaggtt ataagcaatg ccttgaaagt 301 ttggggttta gaactaatcc tgttcaacag tccagagtat cagaggctca ggatcgatcc 361 tataaatgaa agatcattta tatgcaatta taggaacac tggtttacag ttagaaaatt 421 aggaaaacag tggtttaact tgaattctct cttgacgggt ccagagttaa tatcagatac 481 atatcttgca cttttcttgg ctcaattaca acaggaaggt tattctatat ttgttgttaa 541 gggtgacctg ccagattgcg aagctgacca actcctgcag atgatcaggg tccaacagat 601 gcaccgacca aaacttattg gagaagaatt agcacaactg aaagagcaaa gagtccataa 661 aacagacctg gaacgagtgt tagaagcaaa tgatggctca ggaatgttag atgaagatga 721 ggaggatttg cagagggctc tggcactaag tcgccaagaa attgacatgg aagatgagga 781 agcagatctc cgcagggcta ttcagctaag tatgcaaggt agttccagaa atatatctca 841 agatattcca cagacatcag gtacaaatct tacttcagaa gagcttcgga agagacgaga 901 agcctacttt gaaaaacagc agcaacagca gaagcagcag cagcagcagc agcagggggga 961 cctatcagga cagagttcac atccatgtga aaggccaacc accagttcag gagcacttgg 1021 gagtgatcta ggtgatgcta tgggtgaaga agacatgctt caggcagctg tgaccatgtc 1081 tttagaaact gtcagaaatg atttgaaaac agaaggaaaa aaataatacc tttaaaaaat 1141 aattgagata ttcatacttt ccaacattat tctgtgtgat tacagcatag ggtccacttt 1201 ggtaatgtgt caaagagatg aggaaataag acttttagtg gtttgcaaac aaaatgatgg 1261 gcaagtggaa caatgcgtca gttgtaggac taaataatga tcttccaaat attagccaaa 1321 gaggcattca gcaattaaag acatataaaa tagtttteta aatgtttctt tttcttttt 1381 gagtgtgcaa tatctaacat gtctaaaatt aggggcattt ttcttggatc tttttgcaga 1441 ccagctaatt agctcttgcc tcaggctttt tccagttttc tttttctctc ttgtagataa 1501 tttggctcac atcatctaat agtgactttc atttcttatt aaccaaatta acctttcagg 1561 aaagtatctc tagtctgtgt tgataatagt aatggttcta gaaggataaa cagtcctccc 1621 ttcaactgta tactgtgtgc tccagtgttt tcttgtgtta ttttctctga tcacaacttt 1681 tctgcgacct ggttttcatt attttcccac aattcttttg aaagatggta atcttttctg 1741 aggtctagca ttttaagtcc tgtgatggga tcattatttc atgactggtg cattcctaaa
```

-continued

```
1801 ctctgaaatc agccctgcgc aagtacttga gaataaatga gcgttttttta aaatgtgtga 1861 gcatgtgctt tcccagatgc tttcccagat gctttatgaa tatcttttca cttacatcaa 1921 aaccttacag ctttgttgca acccctttctt cctgcgcctt attttttttcct tctccaattg 1981 agaaaac
```

Reverse complement of SEQ ID NO: 3

SEQ ID NO: 4 gttttctcaattggagaaggaaaaaataaggcgcaggaagaaggggttgcaacaaagctgtaaggttttga tgtaagtgaaaagatattcataaagcatctgggaaagcatctgggaaagcacatgctcacacatttttaaaa aacgctcatttattctcaagtacttgcgcagggctgatttcagagtttaggaatgcaccagtcatgaaata atgatcccatcacaggacttaaaatgctagacctcagaaaagattaccatctttcaaaagaattgtgggaa aataatgaaaccaggtcgcagaaaagttgtgatcagagaaaataacacaagaaaacactggagcacacag tatacagttgaagggaggactgtttatccttctagaaccattactattatcaacacagactagagatactt tcctgaaaggttaatttggttaataagaaatgaaagtcactattagatgatgtgagccaaattatctacaa gagagaaaagaaaactggaaaaagcctgaggcaagagctaattagctggtctgcaaaaagatccaagaaa aatgcccctaattttagacatgttagatattgcacactcaaaaaagaaaaagaaacatttagaaaactatt ttatatgtctttaattgctgaatgcctctttggctaatatttggaagatcattatttagtcctacaactga cgcattgttccacttgcccatcattttgtttgcaaaccactaaaagtcttatttcctcatctctttgacac attaccaaagtggaccctatgctgtaatcacacagaataatgttggaaagtatgaatatctcaattatttt ttaaaggtattatttttttccttctgtttttcaaatcatttctgacagtttctaaagacatggtcacagctg cctgaagcatgtcttcttcacccatagcatcacctagatcactcccaagtgctcctgaactggtggttggc ctttcacatggatgtgaactctgtcctgataggtccccctgctgctgctgctgctgctgcttctgctgttg ctgctgttttttcaaagtaggcttctcgtctcttccgaagctcttctgaagtaagatttgtacctgatgtct gtggaatatcttgagatatatttctggaactaccttgcatacttagctgaatagccctgcggagatctgct tcctcatcttccatgtcaatttcttggcgacttagtgccagagccctctgcaaatcctcctcatcttcatc taacattcctgagccatcatttgcttctaacactcgttccaggtctgtttttatggactctttgctctttca gttgtgctaattcttctccaataagttttggtcggtgcatctgttggaccctgatcatctgcaggagttgg tcagcttcgcaatctggcaggtcacccttaacaacaaatatagaataaccttcctgttgtaattgagccaa gaaaagtgcaagatatgtatctgatattaactctggacccgtcaagagagaattcaagttaaaccactgtt ttcctaattttctaactgtaaaccagtgttccttataattgcatataaatgatctttcatttataggatcg atcctgagcctctgatactctggactgttgaacaggattagttctaaaccccaaactttcaaggcattgct tataacctgaatagagaaaaaaccactgtcatccatattttccagaaggctgctgtaaaaacgtgcgataat cttcactagtaactcctccttctgccattctcatcctctcctcctcatccagctgatgtgcaattgaggat aattccacagggctaaaatattctccttgcaataaattattcaggcaatgttgagcacaaagtgagccttc ttgtttctcgtggaagatggactccatgtttatttgtctggagccaacggcccccacaccgaaccacccc LOCUS NM_0297055376 bpm RNAlinear ROD 10 MAR. 2019
DEFINITION *Mus musculus* ataxin 3 (Atxn3), transcript variant 1, mRNA.
VERSION NM_029705.3

SEQ ID NO: 5

```
  1 ggaccggggc tgaggggtgg ggccgggggc ggagctgctg gaggggggctg ctccgcgccg 61 gggccgttgg ctccagacaa ataaacatgg agtccatctt ccacgagaaa caagaaggct 121 cactttgtgc tcagcattgc ctgaataacc tattgcaagg agagtatttt agccctgtgg 181 agctatcctc aattgcacac cagctggatg aagaggagag gctgagaatg gcagaagggg 241 gagtcactag tgaagactac cgcacatttt tacagcagcc ttctggaaat atggatgaca
```

-continued

```
 301 gcggcttttt ctctattcaa gttataagca atgctttgaa agtttggggt ttagaactaa 361 tcctgttcaa cagtccagag taccagaggc tcagaattga tcctataaac gaaagatcct 421 ttatatgcaa ttataaagaa cactggttta cagttagaaa attaggcaag cagtggttta 481 acttgaattc tctgttgacg ggtccagaat taatatcaga tacatacctc gcactattct 541 tggctcaatt acagcaagaa ggttattcta tatttgttgt taagggtgat ctgccagatt 601 gtgaagctga ccaacttttg cagatgatca aggtccaaca gatgcatcga ccaaaactta 661 ttggagagga acttgcacat ctgaaagagc agagtgccct caaagcagac ctggagcgcg 721 tcttagaagc agctgatggg tcgggcatat ttgatgaaga tgaggatgat ttacagaggg 781 ctctagccat aagtcgccag gaaatcgaca tggaggatga agaagctgat ctccgcaggg 841 ccattcagct cagtatgcaa ggtagttcca gaagtatgtg tgaaaatagt ccacagacat 901 caagtccaga tctctcttca gaagagctgc ggaggagacg agaagcctac tttgaaaagc 961 aacagcagca gcagcaggag gtagaccgac ctggacccct ttcatatcca cgtgaaagac 1021 cgaccacaag ttcaggagga cgtaggagcg accaaggagg cgacgctgtg agtgaagagg 1081 acatgcttcg ggcagctgtg accatgtctt tagaaactgc taaagacaac ttgaaagcag 1141 aaagaaaaaa atagtacctt taaaagtcat tttgctactc cactttgta acattgtctg 1201 tgtgattaca gtgtaagggc cactttggca gtatgttcac cagaagagat aaagacactg 1261 tagtggtttg taagcagaaa ggcagaaatg tgtcatagga ctaaggaacg atcgagatac 1321 tagccaaaga ggcagtcagc aatgaaagaa acttttctaa atgtcccgtt ttgttttttca 1381 aatgtgcaat atctgactga aattatgaa ttttttgttgg ctcttttgga ccaactgatt 1441 agctcttgcc acagaacttg atcctataat gtttcgtttt ctctctgcat tgggggtggc 1501 ttggctcact tgagctttta cttcatttca gacctacctt ttatgaaatg tcttttatat 1561 gtcttgttac agaaagatca gtctgtcttc tcatacatat gtcgggcacg tggatgcttc 1621 ctggtggtat tttctctaat gtggtgatgt gttgctttta aagcctttgt tagtgggatc 1681 acatttccta attgtgctgc attcctctac tctgcagtca gctctgttct tgtaactgag 1741 cacgtgagcg tgctctgtct ggatgccctg agagtggctg actcctggct ggagcccttc 1801 ctgtaccttc cttcctctct tctccagctg agaaaagagg aggcagagga cacaaacaga 1861 tttccttcta cgtaacatgc accatgaatg caccacagga gaaactcgcc cttcagtcct 1921 ggtggtgggt ttgtcctagt tttttcatctg tgacaggagc tttgtgttct aatcacgatt 1981 aagtcctgga aaatagatgc ctgcttcact ttctaaaaat taaaaatatt ttttttttctt 2041 tttctagtag aaaataggct gctaggatga tggtctagaa tctgaaagta atttactaat 2101 aaaatatatt taaataatac tgtgggttga cccttgcaat catgtttaaa tcgcttaaga 2161 attacagaag tcacaaagct taaagggtct gtttgtaaat aggaaagtcc ttagttttga 2221 taaacattaa gcaggatgca gagctagtct tgctgggtca atacgtggta tgatttgggt 2281 ggaaattaac tctgtgtctt tgtcatggtg tcatagatac cctgatacct gctttccccct 2341 ccctcccctt tgaagcccct ttgaatggtg acttgtacat aggtaaagtc caagaagaga 2401 ttgtagccag cttaggaagg ggcagcatgc tatagtgctc tactggtgtg tgctctgcac 2461 acgtttttat cagggaaagt tttggatgta ggatttattg ctgtctaact gaaaaagata 2521 caaatatttt tatttatgct tatgaaatag ctttttcttg ataggatgga tgtttggttt 2581 ggtttggttg tgcgagggat tgaacccagg gcctccagtg tgctaggcaa gcgccctacc 2641 tctgagctat atccccagat ccagaacagg ggttccttg tttgcttttt gttgtttttc 2701 ttagccattt tgtgccaact acagttgttt tttaaaaatt tgcttcatga aaaattaggc
```

-continued

```
2761 agtcctattt taaaatctat gaagttttct ttcagtaatt gcaaaggttc agaagagttg 2821 ggcagctgta gggtgttaga gttaggactt tgcttacagt tgattgctat actgaagtat 2881 gtaactactc ccgtatgctg ctcacatgtc tagacattca ttggcccttt tcctttaccc 2941 tttgaaaaat cacattaaac tttccataca tttagattgg tgtgctgcct gatgaaaaat 3001 gagaaagcca atatacactt cagctttaac tttagagttt ataaaatgtt catataacac 3061 accctactta aatcatgtat gaaatacagc atgttagtct tttattagaa atgttttaaa 3121 gagaaactga gcacacactg aatctatttg agtgaagctt tttagtttgt tatatttatg 3181 gcattgtcca ggcagatcca aaatcaccat tgaattgcca tcctctttgg gttgacctag 3241 gcttactaaa catttagatt tcattattaa tgagtagcca gtatgaaaag atgccaatgc 3301 ttattctagc cacagtatcc aaagtgtagg agttctatga cattctaatt cataaccagg 3361 agttgctgtt tatagtactg caggacagac aggggcaagg gactccactg ccacggctgg 3421 tcacagactc gactaacttt tccatttgtt tttttaccaa ttggaatact taaatgtatt 3481 gtatgtaatg aatactaaac tactgataat catttttttt aaatctgtaa cttgttctgc 3541 cagataaaat gcgtacagcc gtgatgctag tgttataacc aagtgtaagg accctttgga 3601 aggccagaca tggtgctgtg ttcctttgat gctggtactt aggagaaatc tgcagaggta 3661 ggcagatttc ttcttgagtt caaggccagc ctggtctaca tagtaagttc cagactttct 3721 ggagctgcac agtaagaccc tgtcttaaac aaaaaacaaa caaaccaacc tttggaaaga 3781 tcactttcat attttgggat gtcatgagct tatctatgtt tcaaaattca gaatagctgt 3841 cctttggcct aaaccataaa tctacacccc caacgacagt actatgcaga catttcactg 3901 atttaagttg tttgatacag tcagtgcagg tgaactccat gctaaagttt taagccttgg 3961 ccaaataact tacacctcac agactgtctg aggcggtgct tctttttttc ctgaaaactt 4021 gattttttctt gatgaagcca aagttaatga gcatgaattc tcaaaggagt agtctgcttt 4081 gttttactta atatcaggtt gagtgaagta agttttattc gtgtcagagt ctaagccaca 4141 cattttgaat acccacatgt ttgatactat ttaagtcatg ctgtgccaag agttactaaa 4201 ttcttagaac tggccctgtg ccctgcctaa ggccagacag ggcagtgcgg aacccaaatg 4261 tgctatctga gagtcttaag ctaggaaatc tgggtgtttt aaattagtga gaggtttcag 4321 ttagtgttga aacctccaga tccgacttga tgttaggcag tgtggatgtg ctcagtggta 4381 gagcagttac ctagtggccc aggccttggg ttcagtctct aacactgcaa aaggagagca 4441 gtggctcaca gtgtaaccta cgtttagaga gacatgaaag gaagtacttt caaagtgaat 4501 gtttgttgta atttagtcct aacaagtgta gagctatgat atgtgacctt aattaagaaa 4561 aaccagattg gatcagtagt attttgttg tttttcatat ttaacataaa aattcccttc 4621 atccctaatt tgtttataat taaagagaca aattgatttt gtattttttc aaagttttat 4681 acatattaaa agggttttgt tgtagtctat catgaatgaa aaggatattt tttttttttaa 4741 tttgaggaat acttttgtgt gtgtgtgcct aaaatggtct gtcattttaa gaattagcac 4801 aaaaaaaaaa ttagctagtt cctaaatgta tggaggttta atagtaccag tacacagttg 4861 tgggtgaggc actagtgaga agtgtgtggg aaatgcagct gggtaggtgg gactcacttg 4921 tctctgaatg gtttaaaggt ggtatttcct ggaatttttt taatgatttt tttttttcaag 4981 gaagacagac attcgaaatg tgcttatcaa atttctacaa cactggacta ataggaataa 5041 ctttttttttt aaaaaaaaaa gactgttctg tataaataaa atatatgaaa ctcaagtgca 5101 aaagccgtga aaataaaagg cattgtcttc tgtcaatgtg atgcactgtg gccgagcagt
```

-continued

```
5161 tccctcagga ctcaactctg cagcccttcc tcctgtgcct caagtgtcgg ctgccactcc 5221 acaggtcttc cgtctgtcgg ctcctttgaa agccgggctt ccaaagccct gttgaacact 5281 gagggttctg gtgatgtgtg ttaatgagtt gtattttaaa tatcagagat tattaaataa 5341 agagaatgat tttctattaa aaaaaaaaaa aaaaaa
```

Reverse complement of SEQ ID NO: 5

SEQ ID NO: 6

```
tttttttttttttttttttaatagaaaatcattctctttatttaataatctctgatatttaaaatacaactc attaacacacatcaccagaaccctcagtgttcaacagggctttggaagcccggctttcaaaggagccgaca gacggaagacctgtggagtggcagccgacacttgaggcacaggaggaagggctgcagagttgagtcctgag ggaactgctcggccacagtgcatcacattgacagaagacaatgccttttattttcacggcttttgcacttg agtttcatatattttatttatacagaacagtcttttttttttttaaaaaaaaagttattcctattagtccagt gttgtagaaatttgataagcacatttcgaatgtctgtcttccttgaaaaaaaaaatcattaaaaaaattcc aggaaataccacctttaaaccattcagagacaagtgagtcccacctacccagctgcatttcccacacactt ctcactagtgcctcacccacaactgtgtactggtactattaaacctccatacatttaggaactagctaatt ttttttttgtgctaattcttaaaatgacagaccattttaggcacacacacacaaaagtattcctcaaatta aaaaaaaaaatatccttttcattcatgatagactacaacaaaacccttttaatatgtataaaactttgaaa aaatacaaaatcaatttgtctctttaattataaacaaattagggatgaagggaattttttatgttaaatatg aaaacaacaaaaatactactgatccaatctggttttttcttaattaaggtcacatatcatagctctacact tgttaggactaaattacaacaaacattcactttgaaagtacttcctttcatgtctctctaaacgtaggtta cactgtgagccactgctctccttttgcagtgttagagactgaacccaaggcctgggccactaggtaactgc tctaccactgagcacatccacactgcctaacatcaagtcggatctggaggtttcaacactaactgaaacct ctcactaatttaaaacacccagatttcctagcttaagactctcagatagcacatttgggttccgcactgcc ctgtctggccttaggcagggcacagggccagttctaagaatttagtaactcttggcacagcatgacttaaa tagtatcaaacatgtgggtattcaaaatgtgtggcttagactctgacacgaataaaacttacttcactcaa cctgatattaagtaaaacaaagcagactactcctttgagaattcatgctcattaactttggcttcatcaag aaaaatcaagttttcaggaaaaaaagaagcaccgcctcagacagtctgtgaggtgtaagttatttggccaa ggcttaaaactttagcatggagttcacctgcactgactgtatcaaacaacttaaatcagtgaaatgtctgc atagtactgtcgttgggggtgtagatttatggtttaggccaaaggacagctattctgaattttgaaacata gataagctcatgacatcccaaaatatgaaagtgatctttccaaaggttggtttgtttgtttttttgtttaag acagggtcttactgtgcagctccagaaagtctggaacttactatgtagaccaggctggccttgaactcaag aagaaatctgcctacctctgcagatttctcctaagtaccagcatcaaaggaacacagcaccatgtctggcc ttccaaagggtccttacacttggttataacactagcatcacggctgtacgcattttatctggcagaacaag ttacagatttaaaaaaaatgattatcagtagtttagtattcattacatacaatacatttaagtattccaat tggtaaaaaacaaatggaaaagttagtcgagtctgtgaccagccgtggcagtggagtcccttgcccctgt ctgtcctgcagtactataaacagcaactcctggttatgaattagaatgtcatagaactcctacactttgga tactgtggctagaataagcattggcatcttttcatactggctactcattaataatgaaatctaaatgttta gtaagcctaggtcaacccaaagaggatggcaattcaatggtgattttggatctgcctggacaatgccataa atataacaaactaaaaagcttcactcaaatagattcagtgtgtgctcagtttctctttaaaacatttctaa taaaagactaacatgctgtatttcatacatgatttaagtagggtgtgttatatgaacattttataaactct aaagttaaagctgaagtgtatattggctttctcatttttcatcaggcagcacaccaatctaaatgtatgga aagtttaatgtgattttttcaaagggtaaaggaaaagggccaatgaatgtctagacatgtgagcagcatacg ggagtagttacatacttcagtatagcaatcaactgtaagcaaagtcctaactctaacaccctacagctgcc
```

-continued

```
caactcttctgaacctttgcaattactgaaagaaaacttcatagattttaaaataggactgcctaattttt catgaagcaaatttttaaaaaacaactgtagttggcacaaatggctaagaaaaacaacaaaaagcaaaca aggaaacccctgttctggatctggggatatagctcagaggtagggcgcttgcctagcacactggaggccct gggttcaatccctcgcacaaccaaaccaaaccaaacatccatcctatcaagaaaaagctatttcataagca taaataaaaatatttgtatctttttcagttagacagcaataaatcctacatccaaaactttccctgataaa aacgtgtgcagagcacacaccagtagagcactatagcatgctgcccttcctaagctggctacaatctctt cttggactttacctatgtacaagtcaccattcaaaggggcttcaaaggggagggagggaaagcaggtatc agggtatctatgacaccatgacaaagacacagagttaatttccacccaaatcataccacgtattgacccag caagactagctctgcatcctgcttaatgtttatcaaaactaaggactttcctatttacaaacagacccttt aagctttgtgacttctgtaattcttaagcgatttaaacatgattgcaagggtcaacccacagtattattta aatatattttattagtaaattactttcagattctagaccatcatcctagcagcctattttctactagaaaa agaaaaaaaaatatttttaattttttagaaagtgaagcaggcatctattttccaggacttaatcgtgattag aacacaaagctcctgtcacagatgaaaaactaggacaaacccaccaccaggactgaagggcgagtttctcc tgtggtgcattcatggtgcatgttacgtagaaggaaatctgtttgtgtcctctgcctcctcttttctcagc tggagaagagaggaaggaaggtacaggaagggctccagccaggagtcagccactctcagggcatccagaca gagcacgctcacgtgctcagttacaagaacagagctgactgcagagtagaggaatgcagcacaattaggaa atgtgatcccactaacaaaggctttaaaagcaacacatcaccacattagagaaaataccaccaggaagcat ccacgtgcccgacatatgtatgagaagacagactgatctttctgtaacaagacatataaaagacatttcat aaaaggtaggtctgaaatgaagtaaaagctcaagtgagccaagccacccccaatgcagagagaaaacgaaa cattataggatcaagttctgtggcaagagctaatcagttggtccaaaagagccaacaaaaattccataatt tcagtcagatattgcacatttgaaaaacaaaacgggacatttagaaaagtttctttcattgctgactgcct ctttggctagtatctcgatcgttccttagtcctatgacacatttctgcctttctgcttacaaaccactaca gtgtctttatctcttctggtgaacatactgccaaagtggcccttacactgtaatcacacagacaatgttac aaagtgtgagtagcaaaatgacttttaaaggtactatttttttctttctgctttcaagttgtctttagcag tttctaaagacatggtcacagctgcccgaagcatgtcctcttcactcacagcgtcgcctccttggtcgctc ctacgtcctcctgaacttgtggtcggtctttcacgtggatatgaaaggggtccaggtcggtctacctcctg ctgctgctgctgttgcttttcaaagtaggcttctcgtctcctccgcagctcttctgaagagagatctggac ttgatgtctgtggactattttcacacatacttctggaactaccttgcatactgagctgaatggccctgcgg agatcagcttcttcatcctccatgtcgatttcctggcgacttatggctagagccctctgtaaatcatcctc atcttcatcaaatatgcccgacccatcagctgcttctaagacgcgctccaggtctgctttgagggcactct gctcttcagatgtgcaagttcctctccaataagtttttggtcgatgcatctgttggaccttgatcatctgc aaaagttggtcagcttcacaatctggcagatcacccttaacaacaaatatagaataaccttcttgctgtaa ttgagccaagaatagtgcgaggtatgtatctgatattaattctggacccgtcaacagagaattcaagttaa accactgcttgcctaattttctaactgtaaaccagtgttctttataattgcatataaaggatctttcgttt ataggatcaattctgagcctctggtactctggactgttgaacaggattagttctaaaccccaaactttcaa agcattgcttataacttgaatagagaaaaagccgctgtcatccatatttccagaaggctgctgtaaaaatg tgcggtagtcttcactagtgactcccccttctgccattctcagcctctcctcttcatccagctggtgtgca attgaggatagctccacagggctaaaatactctccttgcaataggttattcaggcaatgctgagcacaaag tgagccttcttgtttctcgtggaagatggactccatgtttatttgtctggagccaacggccccggcgcgga gcagcccctccagcagctccgcccccggcccacccctcagccccggtcc
```

-continued

```
LOCUS       XM_0062404935240 bpmRNAlinear ROD 26 JUL. 2016
DEFINITION PREDICTED: Rattus norvegicus
ataxin 3 (Atxn3), transcript
variant X4, mRNA.
VERSION    XM_006240493.3
                                                          SEQ ID NO: 7
   1 gggggcggag ctgctggagg gggctgctcc gcgccggggc cgttggctcc agacaaataa 61 acatggagtc catcttccac gagaaacaag aaggctccct ttgcgctcag cattgcttga 121 ataacctctt acaaggagag tattttagcc ccgtggagct gtcctcaatt gcacaccagc 181 tggatgaaga ggagaggctg cggatggcgg aaggaggggt caccagcgaa gactaccgca 241 cattttaca gcagccttct ggaaatatgg acgacagcgg cttttctct attcaagtta 301 taagcaatgc cttgaaagtt tggggtttag aactaatcct attcaacagt ccagagtacc 361 agaggctcag aatcgatcct ataaatgaaa gatcctttat atgcaattat aaagaacact 421 ggtttacagt tagaaaatta ggaaaacagt ggtttaactt gaattctttg ttgactggtc 481 cagagctaat atcagataca tacctcgcac tgttcttggc tcagttacag caagaaggtt 541 attctatatt tgttgttaag ggtgatctgc cagattgtga agctgaccaa cttttacaga 601 tgatcaaggt ccaacagatg catcgaccaa aacttattgg agaagaactc gcacatctga 661 aagagcagag cgccctcaaa gcagatctgg agcgagtctt agaggcggct gacgggccgg 721 gaatgtttga tgatgatgag gacgatttac agagggctct ggccatgagt cgccaggaaa 781 tcgacatgga ggacgaagaa gccgatctcc gcagggccat tcagctcagt atgcaaggta 841 gttccagagg tatgtgtgaa gatagtccgc agacatcaag cacagatctt tcttcagaag 901 agctgcggaa gaggagagaa gcctactttg aaaagcaaca gcatcagcaa caggaagcag 961 accgacctgg ataccttca tacccatgtg aaagacccac cacaagttca ggaggactcc 1021 ggagcaacca aggcaatgct atgagtgaag aggacgtgct tcgggcaact gtgactgtgt 1081 ctttagaaac tgctaaagac agtttgaaag cagaaagaaa aaaatagtcc ctttaaaaat 1141 cattttgcca ccatgctttg taacattgtt tgtgtgatca cagtgtaagg tccactttgg 1201 cagcagtgtg ttcaccggaa ggcagcagac actgcatggt ttgtaagcag aaagggcaga 1261 agcgtcctag gactaaagaa ccacgagatg ctagccaaag aggcagtcag caatgaaaga 1321 aacaacgtag ttttctaaat gtccctcctt gtttttcaaa tgtgcaatat ctgactgaaa 1381 ttatggaatt ttccttggct cttttggacc aactcgttag ctcttgccac agaacttgat 1441 cctgtagagt tccgtcttct ctctgcattg gagctggctt ggcttgtttg ggctttttctt 1501 catttcacac caaccttttg tgaaatatcg tttgtatgtc ttgctatgga aagatcagtc 1561 tgtctttcg tgtatgtgtc aggcacatgg atgcttcctg gtgttatttt ctctggtttt 1621 ggttattttc ctgcaagtct aacatggtga tctgttggtt ttaaagcctt ttttagtggg 1681 atcattattt aactctggtg cattcctcta ctctaaagtc agccctgttc ttctaaacga 1741 gctgaggttt tttgtgagca cgtgctttct cgatgccctg cgaaggattt cagctgtgtc 1801 ctggctgact tatttccttt cttttccagt tgagaaagga gagacagagg atacaaatat 1861 atttccttct acttaacgtt ctccatgaat gtaccacagg agaacccgcc cttcagtgct 1921 ggtggtgggt tcgttccagt gtttcttctg tgtcaagagc ttagtgttct gtatatgatt 1981 aagtcctgga aaataggtgc ctgcttcact ttttaatttt taaaaataaa ttttttttta 2041 ttttagtaga aaataggctg ctaggatgat ggtctaggat gtgaaagtaa tttactaatg 2101 aaaatatatt taaatatact gtggttgacc cttgctacca tgttaaaatt gttaagaatt 2161 acagaagtca caatacttaa aggatctgtt tgtaaatacg aaagtcctta gttttgataa 2221 acattaagtg agatgcacat ctggtcttgc tgggtcaatg ctttggtatg atttgggtgg
```

2281 aaattaacta tgtgtgtttg tcctgggtgt catagatcct gatactgttt tcccctccct 2341 accctttttg aagccccttt gaatgttaac ttgtacatag gtaaaatcaa gaagaaattt 2401 tagccaacag cttagtaagg tgaagcatgg tatattgctc tactgatgtg tgttctgcac 2461 acgtttttat cagggaaagt ttttgatgta ggatttattg ctatctaact gaaaatgata 2521 caaatatttt tatttatgat tatgaaatag ctttctcttg gataggatgg attgtttttgt 2581 ttggctgtgc tagggattga acccagagcc tcgtgtgtgc taggtaagcg ctctacctct 2641 gagctagatc cccagatcca aaacatgtgt ttctcttttg tttgtttttt ttcttagcca 2701 ttttgtgcca attacagttt ctcttttttga aatttgcctc atgaaaaatt agacagtcct 2761 attttcaaat ctatgaagtt ttcttttagt aattgcaaag gttcagaatt atgcagctgt 2821 aggctgttgg gttaggcctt tgcttacagt ggattttttac actgaagtat gcagctaccc 2881 caagtgtgct ggtcacatgt cgagcattga cccttttcctt tacccttttga aaaaccacat 2941 tacactttcc gcacactcag attgatgtgc tgcctgacag ccatttcagt tttaacttca 3001 gagtttataa aacgttcatg taacacaccc tacgtaaatc atgtatgaaa tacagcatgt 3061 tgatctttta ttagaaatgt tttaaagaga aactgagtgt acactgaata tatttgagtg 3121 catttttttaa gtttgttata aattgtggta tttgtccagg caaatccaaa atcaccattg 3181 aactgccatc ccttctattg acctaggctt acctaaacat ttagattcat tattaatgag 3241 taggcagcat gaaaagatgc caatgcttat tataaccaca gtatccaaag tgtaagagtt 3301 gtatgacatt cacgtccgta cacaggagct gctgtttaca gtactgcagg atagatgggc 3361 cagggactcc gctgtcatgg tcctgttatg gacttaactg acatttccat tctgttttta 3421 ccaattggaa tactttaatg tttaatatttt aaactactga taccatttttt ctaatgtgta 3481 acttatacta ccaaataaaa tatgtacagc cagaatgcta gtgttagaac caagagtagg 3541 aaccctctgg agaccaggca tggtgctaca tgccttcaat ccccgtgcct gggagtcaga 3601 ggcaggcaga ttgcttttttg agttcaaagc cagtctagtc tacagagtaa gttccaaact 3661 tgctgcagct gcatagtagg actctgtctt taaaacaaaa caaaacacaa cacaacacaa 3721 cacaacaaaa acctttggga catttcattg attagatggt ttgatacagt cagtgcaggt 3781 gaactccacg gtgaagtttt aaatgttggc caaataattt acacttcaca gactatctga 3841 ggcggtgctt tttttttttt cctgaaaact tgattttttct tgatgaagcc aaagttaatg 3901 aggatgaatt ctcaaaagga gtagtctgca ttgctttatt taatatcagg ttgagtaaaa 3961 taagttttat tcatgtcaga gtctaagcca cagattttga atacctgaat gtttggtact 4021 atttaaatca tgccagtgcc aagaattact aagttcttag aactggcccc tgtgccatgc 4081 ctgagtccag attgggcagt gcagaaccca gatgtgctat ccgagagtct gaagctgggg 4141 agtctgatgt tttagtcagg aagaggcttc agttaatacc gaaacctcca gagacaggtt 4201 attgtcaggc agtgccatgt gctcagtggt agagcagcca cctagaggcc caggccttgt 4261 gctcagtccc taacactgca aaagaagaac aggggctcac agtgaatcca cgttcagaga 4321 ggccttacag ggagtatttt ccaagggagt tgtttgttgt agtttagtcc taacaagtgt 4381 agagctgtaat aggtgacct taagaaaaac caggtggcat cagctaatca gtacagagtt 4441 ttttggtttt catatttaga aactctccct ttattcctaa ttcgtttata attaaagaca 4501 agaattggtt ttgtattttt caaagttttta tgcataataa aatgttttgt tgtagtcttt 4561 caggaatgaa aaggatattg acttttttttt taaaatttga ggtgtgtgtg tgtgtgtgtg 4621 tgtgcgcaca tgtgtgtgtg tgcaagcacc taaaatgggt ctgtcatttt aagaattagc -continued

```
4681 acaaaaaata tagtccctgt tatggaggtt taataatacc agtacacatt gtaagtgcag 4741 tcctaggtga ggcactagtg agaagtgtgt ggaaaatgca gttacctagg taggactcac 4801 ttgtctctta agtagtttaa aggtagtatg tttcctggaa tttttttaatg tttttttttc 4861 tttttttttga ggaagataga catttgaaat gtgattatct aatttctata acactggact 4921 aataggaata acttttttaaa aaatgactgt tctgtataga taaaatatat tgaactcaag 4981 tgcaaaagcc atgagattaa aggcattgtc ttctggtcaa tatgatgcac tgtagcggag 5041 cagttcctca ggacacaact ctgcagccct tcctcctgtg cctcaagttg atggctgcca 5101 ctccacaggt cttccgtctg tctgctcctt tgaaagctgg gcttccaaag cactgttgaa 5161 cactgagggt cctgttgata ttaatgagtt gtattttaaa tatcagagat tattaaataa 5221 agagaatgat tttctattaa
```

Reverse complement of SEQ ID NO: 7

SEQ ID NO: 8

```
ttaatagaaaatcattctctttatttaataatctctgatatttaaaatacaactcattaatatcaacagga ccctcagtgttcaacagtgctttggaagcccagctttcaaaggagcagacagacggaagacctgtgggagtg gcagccatcaacttgaggcacaggaggaagggctgcagagttgtgtcctgaggaactgctccgctacagtg catcatattgaccagaagacaatgcctttaatctcatggcttttgcacttgagttcaatatattttatcta tacagaacagtcattttttaaaaagttattcctattagtccagtgttatagaaattagataatcacatttc aaatgtctatcttcctcaaaaaaaagaaaaaaaaacattaaaaaattccaggaaacatactacctttaaac tacttaagagacaagtgagtcctacctaggtaactgcattttccacacacttctcactagtgcctcaccta ggactgcacttacaatgtgtactggtattattaaacctccataacagggactatattttttgtgctaattc ttaaaatgacagacccatttttaggtgcttgcacacacacacatgtgcgcacacacacacacacacacacac ctcaaattttaaaaaaaaagtcaatatcctttcattcctgaaagactacaacaaaacattttattatgca taaaactttgaaaaatacaaaaccaattcttgtctttaattataaacgaattaggaataaagggagagttt ctaaatatgaaaaccaaaaaactctgtactgattagctgatgccacctggttttttcttaaggtcacctatt acagctctacacttgttaggactaaactacaacaaacaactcccttggaaaatactccctgtaaggcctct ctgaacgtggattcactgtgagcccctgttcttcttttgcagtgttagggactgagcacaaggcctgggcc tctaggtggctgctctaccactgagcacatggcactgcctgacaataacctgtctctggaggtttcggtat taactgaagcctcttcctgactaaaacatcagactccccagcttcagactctcggatagcacatctgggtt ctgcactgcccaatctggactcaggcatggcacaggggccagttctaagaacttagtaattcttggcactg gcatgatttaaatagtaccaaacattcaggtattcaaaatctgtggcttagactctgacatgaataaaact tattttactcaacctgatattaaataaagcaatgcagactactccttttgagaattcatcctcattaactt tggcttcatcaagaaaaatcaagttttcaggaaaaaaaaaaaagcaccgcctcagatagtctgtgaagtgt aaattatttggccaacatttaaaacttcaccgtggagttcacctgcactgactgtatcaaaccatctaatc aatgaaatgtcccaaaggttttgttgtgttgtgttgtgttgtgttttgtttgtttttaaagacagagtcc tactatgcagctgcagcaagtttggaacttactctgtagactagactggctttgaactcaaaaagcaatct gcctgcctctgactcccaggcacggggattgaaggcatgtagcaccatgcctggtctccagagggttccta ctcttggttctaacactagcattctggctgtacatattttatttggtagtataagttacacattagaaaaa tggtatcagtagtttaaatattaaacattaaagtattccaattggtaaaaacagaatggaaatgtcagtta agtccataacaggaccatgacagcggagtccctggcccatctatcctgcagtactgtaaacagcagctcct gtgtacggacgtgaatgtcatacaactcttacactttggatactgtggttataataagcattggcatcttt tcatgctgcctactcattaataatgaatctaaatgtttaggtaagcctaggtcaatagaagggatggcagt tcaatggtgattttggatttgcctggacaaataccacaatttataacaaacttaaaaaatgcactcaaata
```

-continued tattcagtgtacactcagtttctctttaaaacatttctaataaaagatcaacatgctgtatttcatacatg atttacgtagggtgtgttacatgaacgtttttatataaactctgaagttaaaactgaaatggctgtcaggcagc acatcaatctgagtgtgcggaaagtgtaatgtggttttttcaaagggtaaaggaaagggtcaatgctcgaca tgtgaccagcacacttggggtagctgcatacttcagtgtaaaaatccactgtaagcaaaggcctaacccaa cagcctacagctgcataattctgaacctttgcaattactaaaagaaaacttcatagatttgaaaataggac tgtctaattttttcatgaggcaaatttcaaaaagagaaactgtaattggcacaaaatggctaagaaaaaaaa caaacaaaagagaaacacatgttttggatctggggatctagctcagaggtagagcgcttacctagcacaca cgaggctctgggttcaatccctagcacagccaaacaaaacaatccatcctatccaagagaaagctatttca taatcataaataaaaatatttgtatcattttcagttagatagcaatataaatcctacatcaaaaactttccct gataaaaacgtgtgcagaacacacatcagtagagcaatataccatgcttcaccttactaagctgttggcta aaatttcttcttgattttacctatgtacaagttaacattcaaaggggcttcaaaaagggtagggaggggaa aacagtatcaggatctatgacacccaggacaaacacacatagttaatttccacccaaatcataccaaagca ttgacccagcaagaccagatgtgcatctcacttaatgtttatcaaaactaaggactttcgtatttacaaac agatcctttaagtattgtgacttctgtaattcttaacaattttaacatggtagcaagggtcaaccacagta tatttaaatatattttcattagtaaattactttcacatcctagaccatcatcctagcagcctattttctac taaaataaaaaaaaatttattttttaaaaattaaaaagtgaagcaggcacctattttccaggacttaatcat atacagaacactaagctcttgacacagaagaaacactggaacgaacccaccaccagcactgaagggcgggt tctcctgtggtacattcatggagaacgttaagtagaaggaaatatatttgtatcctctgtctctcctttct caactggaaaagaaaggaaataagtcagccaggacacagctgaaatccttcgcagggcatcgagaaagcac gtgctcacaaaaaacctcagctcgtttagaagaacagggctgactttagagtagaggaatgcaccagagtt aaataatgatcccactaaaaaaggctttaaaaccaacagatcaccatgttagacttgcaggaaaataacca aaaccagagaaaataacaccaggaagcatccatgtgcctgacacatacacgaaaagacagactgatctttc catagcaagacatacaaacgatatttcacaaaaggttggtgtgaaatgaagaaaagcccaaacaagccaag ccagctccaatgcagagagaagacggaactctacaggatcaagttctgtggcaagagctaacgagttggtc caaaagagccaaggaaaattccataatttcagtcagatattgcacatttgaaaaacaaggagggacattta gaaaactacgttgtttctttcattgctgactgcctctttggctagcatctcgtggttcttagtcctagga cgcttctgccctttctgcttacaaaccatgcagtgtctgctgccttccggtgaacacactgctgccaaagt ggaccttacactgtgatcacacaaacaatgttacaaagcatggtggcaaaatgatttttaaagggactatt ttttttctttctgctttcaaactgtctttagcagtttctaaagacacagtcacagttgcccgaagcacgtcc tcttcactcatagcattgccttggttgctccggagtcctcctgaacttgtggtgggtctttcacatgggta tgaaaggtatccaggtcggtctgcttcctgttgctgatgctgttgcttttcaaagtaggcttctctcctct tccgcagctcttctgaagaaagatctgtgcttgatgtctgcggactatcttcacacatacctctggaacta ccttgcatactgagctgaatggccctgcggagatcggcttcttcgtcctccatgtcgatttcctggcgact catggccagagccctctgtaaatcgtcctcatcatcatcaaacattcccggcccgtcagccgcctctaaga ctcgctccagatctgctttgagggcgctctgctctttcagatgtgcgagttcttctccaataagtttttggt cgatgcatctgttggaccttgatcatctgtaaaagttggtcagcttcacaatctggcagatcacccttaac aacaaatatagaataaccttcttgctgtaactgagccaagaacagtgcgaggtatgtatctgatattagct ctggaccagtcaacaaagaattcaagttaaaccactgttttcctaattttctaactgtaaaccagtgttct ttataattgcatataaaggatctttcatttataggatcgattctgagcctctggtactctggactgttgaa taggattagttctaaaccccaaactttcaaggcattgcttataacttgaatagagaaaaagccgctgtcgt -continued ccatatttccagaaggctgctgtaaaaatgtgcggtagtcttcgctggtgacccctccttccgccatccgc agcctctcctcttcatccagctggtgtgcaattgaggacagctccacggggctaaaatactctccttgtaa gaggttattcaagcaatgctgagcgcaaagggagccttcttgtttctcgtggaagatggactccatgttta tttgtctggagccaacggccccggcgcggagcagcccctccagcagctccgccccc LOCUSN M_0011647826036 bpmRNAlinear PRI 20 OCT. 2020
DEFINITION *Homo sapiens* ataxin 3 (ATXN3), transcript variant ae, mRNA.
VERSION NM_001164782.2

SEQ ID NO: 1918

GTGGGGGCCGTTGGCTCCAGACAAATAAACATGGAGTCCATCTTCCACGAGAAACAGCAGCAAAAGCAGC

AACAGCAGCAGCAGCAGCAGCAGCAGGGGGACCTATCAGGACAGAGTTCACATCCATGTGAAAGGCCAGCC

ACCAGTTCAGGAGCACTTGGGAGTGATCTAGGTGATGCTATGAGTGAAGAAGACATGCTTCAGGCAGCTGT

GACCATGTCTTTAGAAACTGTCAGAAATGATTTGAAAACAGAAGGAAAAAAATAATACCTTTAAAAAATAA

TTTAGATATTCATACTTTCCAACATTATCCTGTGTGATTACAGCATAGGGTCCACTTTGGTAATGTGTCAA

AGAGATGAGGAAATAAGACTTTTAGCGGTTTGCAAACAAAATGATGGGAAAGTGGAACAATGCGTCGGTTG

TAGGACTAAATAATGATCTTCCAAATATTAGCCAAAGAGGCATTCAGCAATTAAAGACATTTAAAATAGTT

TTCTAAATGTTTCTTTTTCTTTTTTGAGTGTGCAATATGTAACATGTCTAAAGTTAGGGCATTTTTCTTGG

ATCTTTTTGCAGACTAGCTAATTAGCTCTCGCCTCAGGCTTTTTCCATATAGTTTGTTTTCTTTTTCTGTC

TTGTAGGTAAGTTGGCTCACATCATGTAATAGTGGCTTTCATTTCTTATTAACCAAATTAACCTTTCAGGA

AAGTATCTCTACTTTCCTGATGTTGATAATAGTAATGGTTCTAGAAGGATGAACAGTTCTCCCTTCAACTG

TATACCGTGTGCTCCAGTGTTTTCTTGTGTTGTTTTCTCTGATCACAACTTTTCTGCTACCTGGTTTTCAT

TATTTTCCCACAATTCTTTTGAAAGATGGTAATCTTTTCTGAGGTTTAGCGTTTTAAGCCCTACGATGGGA

TCATTATTTCATGACTGGTGCGTTCCTAAACTCTGAAATCAGCCTTGCACAAGTACTTGAGAATAAATGAG

CATTTTTTAAAATGTGTGAGCATGTGCTTTCCCAGATGCTTTATGAATGTCTTTTCACTTATATCAAACC

TTACAGCTTTGTTGCAACCCCTTCTTCCTGCGCCTTATTTTTTCCTTTCTTCTCCAATTGAGAAAACTAGG

AGAAGCATAGTATGCAGGCAAGTCTCCTTCTGTTAGAAGACTAAACATACGTACCCACCATGAATGTATGA

TACATGAAATTTGGCCTTCAATTTTAATAGCAGTTTTATTTTATTTTTTCTCCTATGACTGGAGCTTTGTG

TTCTCTTTACAGTTGAGTCATGGAATGTAGGTGTCTGCTTCACATCTTTTAGTAGGTATAGCTTGTCAAAG

ATGGTGATCTGGAACATGAAAATAATTTACTAATGAAAATATGTTTAAATTTATACTGTGATTTGACACTT

GCATCATGTTTAGATAGCTTAAGAACAATGGAAGTCACAGTACTTAGTGGATCTATAAATAAGAAAGTCCA

TAGTTTTGATAAATATTCTCTTTAATTGAGATGTACAGAGAGTTTCTTGCTGGGTCAATAGGATAGTATCA

TTTTGGTGAAAACCATGTCTCTGAAATTGATGTTTTAGTTTCAGTGTTCCCTATCCCTCATTCTCCATCTC

CTTTTGAAGCTCTTTTGAATGTTGAATTGTTCATAAGCTAAAATCCAAGAAATTTCAGCTGACAACTTCGA

AAATTATAATATGGTATATTGCCCTCCTGGTGTGTGGCTGCACACATTTTATCAGGGAAAGTTTTTTGATC

TAGGATTTATTGCTAACTAACTGAAAAGAGAAGAAAAAATATCTTTTATTTATGATTATAAAATAGCTTTT

TCTTCGATATAACAGATTTTTTAAGTCATTATTTTGTGCCAATCAGTTTTCTGAAGTTTCCCTTACACAAA

AGGATAGCTTTATTTTAAAATCTAAAGTTTCTTTTAATAGTTAAAAATGTTTCAGAAGAATTATAAAACTT

TAAAACTGCAAGGGATGTTGGAGTTTAGTACTACTCCCTCAAGATTTAAAAAGCTAAATATTTTAAGACTG

AACATTTATGTTAATTATTACCAGTGTGTTTGTCATATTTTCCATGGATATTTGTTCATTACCTTTTTCCA

TTGAAAAGTTACATTAAACTTTTCATACACTTGAATTGATGAGCTACCTAATATAAAAATGAGAAAACCAA

TATGCATTTTAAAGTTTTAACTTTAGAGTTTATAAAGTTCATATATACCCTAGTTAAAGCACTTAAGAAAA

TATGGCATGTTTGACTTTTAGTTCCTAGAGAGTTTTTGTTTTTGTTTTTGTTTTTTTTTGAGACGGAGTCT

TGCTATGTCTCCCAGGCTGGAGGGCAGTGGCATGATCTCGGCTCACTACAACTTCCACCTCCCGGGTTCAA

GCAATTCTCCTGCCTCAGCCTCCAGAGTAGCTGGGATTACAGGCGCCCACCACCACACCCGGCAGATTTTT

-continued

```
GTATTTTTGGTAGAGACGCGGTTTCATCATGTTTGGCCAGGCTGGTCTCGAACTCCTGACCTCAGGTGATC

CGCCTGCCTTGGCCTCCCAAAGTGTTGGGATTACAGGCATGAGCCACTGCGCCTGGCCAGCTAGAGAGTTT

TTAAAGCAGAGCTGAGCACACACTGGATGCGTTTGAATGTGTTTGTGTAGTTTGTTGTGAAATTGTTACAT

TTAGCAGGCAGATCCAGAAGCACTAGTGAACTGTCATCTTGGTGGGGTTGGCTTAAATTTAATTGACTGTT

TAGATTCCATTTCTTAATTGATTGGCCAGTATGAAAAGATGCCAGTGCAAGTAACCATAGTATCAAAAAAG

TTAAAAATTATTCAAAGCTATAGTTTATACATCAGGTACTGCCATTTACTGTAAACCACCTGCAAGAAAGT

CAGGAACAACTAAATTCACAAGAACTGTCCTGCTAAGAAGTGTATTAAAGATTTCCATTTTGTTTTACTAA

TTGGGAACATCTTAATGTTTAATATTTAAACTATTGGTATCATTTTTCTAATGTATAATTTGTATTACTGG

GATCAAGTATGTACAGTGGTGATGCTAGTAGAAGTTTAAGCCTTGGAAATACCACTTTCATATTTTCAGAT

GTCATGGATTTAATGAGTAATTTATGTTTTTAAAATTCAGAATAGTTAATCTCTGATCTAAAACCATCAAT

CTATGTTTTTTACGGTAATCATGTAAATATTTCAGTAATATAAACTGTTTGAAAAGGCTGCTGCAGGTAAA

CTCTATACTAGGATCTTGGCCAAATAATTTACAATTCACAGAATATTTTATTTAAGGTGGTGCTTTTTTTT

TTTGTCCTTAAAACTTGATTTTTCTTAACTTTATTCATGATGCCAAAGTAAATGAGGAAAAAAACTCAAAA

CCAGTTGAGTATCATTGCAGACAAAACTACCAGTAGTCCATATTGTTTAATATTAAGTTGAATAAAATAAA

TTTTATTTCAGTCAGAGCCTAAATCACATTTTGATTGTCTGAATTTTTGATACTATTTTTAAAATCATGCT

AGTGGCGGCTGGGCGTGGTAGCTCACGCCTGTAATCCCAGCATTTTGGGAGGCCGAAGTGGGTGGATCACG

AGGTCGGGAGTTCGAGACCAGCTTGGCCAAAATGGTGAAACCCCATCTGTACTAAAAACTACAAAAATTAG

CTGGGCGCGGTGGCAGGTGCCTGTAATCCCAGCTACTGGGAGTCTGAGGCAGGAGAATTGCTTGAACCCT

GGCGACAGAGGATGCAGTGAGCCAAGATGGTGCCACTGTACTCCAGACTGGGCGACAGAGTGAGACTCTGT

CTCAAAAAAAAAAAAAAAATCATGCTAGTGCCAAGAGCTACTAAATTCTTAAAACCGGCCCATTGGACCTG

TACAGATAAAAAATAGATTCAGTGCATAATCAAAATATGATAATTTTAAAATCTTAAGTAGAAAAATAAAT

CTTGATGTTTTAAATTCTTACGAGGATTCAATAGTTAATATTGATGATCTCCCGGCTGGGTGCAGTGGCTC

ACGCCTGTAATCCCAGCAGTTCTGGAGGCTGAGGTGGGCGAATCACTTCAGGCCAGGAGTTCAAGACCAGT

CTGGGCAACATGGTGAAACCTCGTTTCTACTAAAAATACAAAAATTAGCCGGGCGTGGTTGCACACACTTG

TAATCCCAGCTACTCAGGAGGCTAAGAATCGCATGAGCCTAGGAGGCAGAGGTTGCAGAGTGCCAAGGGCT

CACCACTGCATTCCAGCCTGCCCAACAGAGTGAGACACTGTTTCTGAAAAAAAAAAAATATATATATATA

TATATATGTGTGTATATATATGTATATATATATGACTTCCTATTAAAAACTTTATCCCAGTCGGGGGCA

GTGGCTCACGCCTGTAATCCCAACACTTTGGGAGGCTGAGGCAGGTGGATCACCTGAAGTCCGGAGTTTGA

GACCAGCCTGGCCAACATGGTGAAACCCCATCTCTACTAAAAATACAAAACTTAAGCCAGGTATGGTGGCG

GGCACCTGTAATCCCAGTTACTTGGGAGGCTGAGGCAGGAGAATCGTTTAAACCCAGGAGGTGGAGGTTGC

AGTGAGCTGAGATCGTGCCATTGCACTCTAGCCTGGGCAACAAGAGTAAAACTCCATCTTAAAGGTTTGTT

TGTTTTTTTTTAATCCGGAAACGAAGAGGCGTTGGGCCGCTATTTTCTTTTTCTTTCTTTCTTTCTTTCTT

TTTTTTTTTTTCTGAGACGGAGTCTAGCTCTGCTGCCCAGGCTGGAGTACAATGACACGATGTTGGCTCAC

TGCAACCTCCACCTCCTGGGTTCAAGCGATTCTCCTGCCTCAGCCTCCCAAGTACCTGGGATTACAGGCAC

CTGCCACTACACCTGGCGAATATTTGTTTTTTTTAGTAGAGACGGGCTTTTACCATGTTAGGCTGGTCTCA

AACTCCTGACCTCAGGTGATCTGCCTGCCTTGGCCTCCCAAAGTGCTGGGATTACAGGTGCAGGCCACCAC

ACCCGGCCTTGGGCCACTGTTTTCAAAGTGAATTGTTTGTTGTATCGAGTCCTTAAGTATGGATATATATG

TGACCCTAATTAAGAACTACCAGATTGGATCAACTAATCATGTCAGCAATGTAAATAACTTTATTTTTCAT

ATTCAAAATAAAAACTTTCTTTTATTTCTGGCCCCTTTATAACCAGCATCTTTTTGCTTTAAAAAATGACC

TGGCTTTGTATTTTTTTAGTCTTAAACATAATAAAAATATTTTTGTTCTAATTTGCTTTCATGAGTGAAGA
```

-continued

TTATTGACATCGTTGGTAAATTCTAGAATTTTGATTTTGTTTTTTAATTTGAAGAAAATCTTTGCTATTAT

TATTTTTTCCAAGTGGTCTGGCATTTTAAGAATTAGTGCTAATAACGTAACTTCTAAATTTGTCGTAATTG

GCATGTTTAATAGCATATCAAAAAACATTTTAAGCCTGTGGATTCATAGACAAAGCAATGAGAAACATTAG

TAAAATATAAATGGATATTCCTGATGCATTTAGGAAGCTCTCAATTGTCTCTTGCATAGTTCAAGGAATGT

TTTCTGAATTTTTTTAATGCTTTTTTTTTTTTGAAAGAGGAAAACATACATTTTTAAATGTGATTATCTA

ATTTTTACAACACTGGGCTATTAGGAATAACTTTTTAAAAATTACTGTTCTGTATAAATATTTGAAATTCA

AGTACAGAAAATATCTGAAACAAAAAGCATTGTTGTTTGGCCATGATACAAGTGCACTGTGGCAGTGCCGC

TTGCTCAGGACCCAGCCCTGCAGCCCTTCTGTGTGTGCTCCCTCGTTAAGTTCATTTGCTGTTATTACACA

CACAGGCCTTCCTGTCTGGTCGTTAGAAAAGCCGGGCTTCCAAAGCACTGTTGAACACAGGATTCTGTTGT

TAGTGTGGATGTTCAATGAGTTGTATTTTAAATATCAAAGATTATTAAATAAAGATAATGTTTGCTTTTCT

A

Reverse complement of SEQ ID NO: 1918

SEQ ID NO: 1919

TAGAAAAGCAAACATTATCTTTATTTAATAATCTTTGATATTTAAAATACAACTCATTGAACATCCACACT

AACAACAGAATCCTGTGTTCAACAGTGCTTTGGAAGCCCGGCTTTTCTAACGACCAGACAGGAAGGCCTGT

GTGTGTAATAACAGCAAATGAACTTAACGAGGGAGCACACACAGAAGGGCTGCAGGGCTGGGTCCTGAGCA

AGCGGCACTGCCACAGTGCACTTGTATCATGGCCAAACAACAATGCTTTTTGTTTCAGATATTTTCTGTAC

TTGAATTTCAAATATTTATACAGAACAGTAATTTTTAAAAAGTTATTCCTAATAGCCCAGTGTTGTAAAAA

TTAGATAATCACATTTAAAAATGTATGTTTTCCTCTTTCAAAAAAAAAAAAAAGCATTAAAAAAATTCAGAA

AACATTCCTTGAACTATGCAAGAGACAATTGAGAGCTTCCTAAATGCATCAGGAATATCCATTTATATTTT

ACTAATGTTTCTCATTGCTTTGTCTATGAATCCACAGGCTTAAAATGTTTTTTGATATGCTATTAAACATG

CCAATTACGACAAATTTAGAAGTTACGTTATTAGCACTAATTCTTAAAATGCCAGACCACTTGGAAAAAAT

AATAATAGCAAAGATTTTCTTCAAATTAAAAAACAAAATCAAAATTCTAGAATTTACCAACGATGTCAATA

ATCTTCACTCATGAAAGCAAATTAGAACAAAAATATTTTTATTATGTTTAAGACTAAAAAAATACAAAGCC

AGGTCATTTTTTAAAGCAAAAAGATGCTGGTTATAAAGGGGCCAGAAATAAAAGAAAGTTTTTATTTTGAA

TATGAAAAATAAAGTTATTTACATTGCTGACATGATTAGTTGATCCAATCTGGTAGTTCTTAATTAGGGTC

ACATATATATCCATACTTAAGGACTCGATACAACAAACAATTCACTTTGAAAACAGTGGCCCAAGGCCGGG

TGTGGTGGCCTGCACCTGTAATCCCAGCACTTTGGGAGGCCAAGGCAGGCAGATCACCTGAGGTCAGGAGT

TTGAGACCAGCCTAACATGGTAAAAGCCCGTCTCTACTAAAAAAAACAAATATTCGCCAGGTGTAGTGGCA

GGTGCCTGTAATCCCAGGTACTTGGGAGGCTGAGGCAGGAGAATCGCTTGAACCCAGGAGGTGGAGGTTGC

AGTGAGCCAACATCGTGTCATTGTACTCCAGCCTGGGCAGCAGAGCTAGACTCCGTCTCAGAAAAAAAAAA

AAAGAAAGAAAGAAAGAAAAAGAAAATAGCGGCCCAACGCCTCTTCGTTTCCGGATTAAAAAAAAAC

AAACAAACCTTTAAGATGGAGTTTTACTCTTGTTGCCCAGGCTAGAGTGCAATGGCACGATCTCAGCTCAC

TGCAACCTCCACCTCCTGGGTTTAAACGATTCTCCTGCCTCAGCCTCCCAAGTAACTGGGATTACAGGTGC

CCGCCACCATACCTGGCTTAAGTTTTGTATTTTTAGTAGAGATGGGGTTTCACCATGTTGGCCAGGCTGGT

CTCAAACTCCGGACTTCAGGTGATCCACCTGCCTCAGCCTCCCAAAGTGTTGGGATTACAGGCGTGAGCCA

CTGCCCCCGACTGGGATAAAGTTTTTAATAGGAAGTCATATATATATACATATATATATACACACATATAT

ATATATATATATATTTTTTTTTTTCAGAAACAGTGTCTCACTCTGTTGGGCAGGCTGGAATGCAGTGGT

GAGCCCTTGGCACTCTGCAACCTCTGCCTCCTAGGCTCATGCGATTCTTAGCCTCCTGAGTAGCTGGGATT

ACAAGTGTGTGCAACCACGCCCGGCTAATTTTTGTATTTTTAGTAGAAACGAGGTTTCACCATGTTGCCCA

GACTGGTCTTGAACTCCTGGCCTGAAGTGATTCGCCCACCTCAGCCTCCAGAACTGCTGGGATTACAGGCG

TGAGCCACTGCACCCAGCCGGGAGATCATCAATATTAACTATTGAATCCTCGTAAGAATTTAAAACATCAA

-continued

```
GATTTATTTTTCTACTTAAGATTTTAAAATTATCATATTTTGATTATGCACTGAATCTATTTTTTATCTGT

ACAGGTCCAATGGGCCGGTTTTAAGAATTTAGTAGCTCTTGGCACTAGCATGATTTTTTTTTTTTTTTTGA

GACAGAGTCTCACTCTGTCGCCCAGTCTGGAGTACAGTGGCACCATCTTGGCTCACTGCATCCTCTGTCGC

CAGGGTTCAAGCAATTCTCCTGCCTCAGACTCCCAGGTAGCTGGGATTACAGGCACCTGCCACCGCGCCCA

GCTAATTTTTGTAGTTTTTAGTACAGATGGGGTTTCACCATTTTGGCCAAGCTGGTCTCGAACTCCCGACC

TCGTGATCCACCCACTTCGGCCTCCCAAAATGCTGGGATTACAGGCGTGAGCTACCACGCCCAGCCGCCAC

TAGCATGATTTTAAAAATAGTATCAAAAATTCAGACAATCAAAATGTGATTTAGGCTCTGACTGAAATAAA

ATTTATTTTATTCAACTTAATATTAAACAATATGGACTACTGGTAGTTTTGTCTGCAATGATACTCAACTG

GTTTTGAGTTTTTTTCCTCATTTACTTTGGCATCATGAATAAAGTTAAGAAAAATCAAGTTTTAAGGACAA

AAAAAAAAAGCACCACCTTAAATAAAATATTCTGTGAATTGTAAATTATTTGGCCAAGATCCTAGTATAGA

GTTTACCTGCAGCAGCCTTTTCAAACAGTTTATATTACTGAAATATTTACATGATTACCGTAAAAAACATA

GATTGATGGTTTTAGATCAGAGATTAACTATTCTGAATTTTAAAAACATAAATTACTCATTAAATCCATGA

CATCTGAAAATATGAAAGTGGTATTTCCAAGGCTTAAACTTCTACTAGCATCACCACTGTACATACTTGAT

CCCAGTAATACAAATTATACATTAGAAAAATGATACCAATAGTTTAAATATTAAACATTAAGATGTTCCCA

ATTAGTAAAACAAAATGGAAATCTTTAATACACTTCTTAGCAGGACAGTTCTTGTGAATTTAGTTGTTCCT

GACTTTCTTGCAGGTGGTTTACAGTAAATGGCAGTACCTGATGTATAAACTATAGCTTTGAATAATTTTTA

ACTTTTTTGATACTATGGTTACTTGCACTGGCATCTTTTCATACTGGCCAATCAATTAAGAAATGGAATCT

AAACAGTCAATTAAATTTAAGCCAACCCCACCAAGATGACAGTTCACTAGTGCTTCTGGATCTGCCTGCTA

AATGTAACAATTTCACAACAAACTACACAAACACATTCAAACGCATCCAGTGTGTGCTCAGCTCTGCTTTA

AAAACTCTCTAGCTGGCCAGGCGCAGTGGCTCATGCCTGTAATCCCAACACTTTGGGAGGCCAAGGCAGGC

GGATCACCTGAGGTCAGGAGTTCGAGACCAGCCTGGCCAAACATGATGAAACCGCGTCTCTACCAAAAATA

CAAAAATCTGCCGGGTGTGGTGGTGGGCGCCTGTAATCCCAGCTACTCTGGAGGCTGAGGCAGGAGAATTG

CTTGAACCCGGGAGGTGGAAGTTGTAGTGAGCCGAGATCATGCCACTGCCCTCCAGCCTGGGAGACATAGC

AAGACTCCGTCTCAAAAAAAAACAAAAACAAAAACAAAAACTCTCTAGGAACTAAAAGTCAAACATGCCAT

ATTTTCTTAAGTGCTTTAACTAGGGTATATATGAACTTTATAAACTCTAAAGTTAAAACTTTAAAATGCAT

ATTGGTTTTCTCATTTTTATATTAGGTAGCTCATCAATTCAAGTGTATGAAAAGTTTAATGTAACTTTTCA

ATGGAAAAAGGTAATGAACAAATATCCATGGAAAATATGACAAACACACTGGTAATAATTAACATAAATGT

TCAGTCTTAAAATATTTAGCTTTTTAAATCTTGAGGGAGTAGTACTAAACTCCAACATCCCTTGCAGTTTT

AAAGTTTTATAATTCTTCTGAAACATTTTTAACTATTAAAAGAAACTTTAGATTTTAAAATAAAGCTATCC

TTTTGTGTAAGGGAAACTTCAGAAAACTGATTGGCACAAAATAATGACTTAAAAAATCTGTTATATCGAAG

AAAAAGCTATTTTATAATCATAAATAAAAGATATTTTTTCTTCTCTTTTCAGTTAGTTAGCAATAAATCCT

AGATCAAAAAACTTTCCCTGATAAAATGTGTGCAGCCACACACCAGGAGGGCAATATACCATATTATAATT

TTCGAAGTTGTCAGCTGAAATTTCTTGGATTTTAGCTTATGAACAATTCAACATTCAAAAGAGCTTCAAAA

GGAGATGGAGAATGAGGGATAGGGAACACTGAAACTAAAACATCAATTTCAGAGACATGGTTTTCACCAAA

ATGATACTATCCTATTGACCCAGCAAGAAACTCTCTGTACATCTCAATTAAAGAGAATATTTATCAAAACT

ATGGACTTTCTTATTTATAGATCCACTAAGTACTGTGACTTCCATTGTTCTTAAGCTATCTAAACATGATG

CAAGTGTCAAATCACAGTATAAATTTAAACATATTTTCATTAGTAAATTATTTTCATGTTCCAGATCACCA

TCTTTGACAAGCTATACCTACTAAAAGATGTGAAGCAGACACCTACATTCCATGACTCAACTGTAAAGAGA

ACACAAAGCTCCAGTCATAGGAGAAAAAATAAAATAAAACTGCTATTAAAATTGAAGGCCAAATTTCATGT

ATCATACATTCATGGTGGGTACGTATGTTTAGTCTTCTAACAGAAGGAGACTTGCCTGCATACTATGCTTC
```

-continued
TCCTAGTTTTCTCAATTGGAGAAGAAAGGAAAAAATAAGGCGCAGGAAGAAGGGGTTGCAACAAAGCTGTA

AGGTTTTGATATAAGTGAAAAGACATTCATAAAGCATCTGGGAAAGCACATGCTCACACATTTTAAAAAAT

GCTCATTTATTCTCAAGTACTTGTGCAAGGCTGATTTCAGAGTTTAGGAACGCACCAGTCATGAAATAATG

ATCCCATCGTAGGGCTTAAAACGCTAAACCTCAGAAAAGATTACCATCTTTCAAAAGAATTGTGGGAAAAT

AATGAAAACCAGGTAGCAGAAAAGTTGTGATCAGAGAAAACAACACAAGAAAACACTGGAGCACACGGTAT

ACAGTTGAAGGGAGAACTGTTCATCCTTCTAGAACCATTACTATTATCAACATCAGGAAAGTAGAGATACT

TTCCTGAAAGGTTAATTTGGTTAATAAGAAATGAAAGCCACTATTACATGATGTGAGCCAACTTACCTACA

AGACAGAAAAGAAAACAAACTATATGGAAAAAGCCTGAGGCGAGAGCTAATTAGCTAGTCTGCAAAAAGA

TCCAAGAAAAATGCCCTAACTTTAGACATGTTACATATTGCACACTCAAAAAAGAAAAAGAAACATTTAGA

AAACTATTTTAAATGTCTTTAATTGCTGAATGCCTCTTTGGCTAATATTTGGAAGATCATTATTTAGTCCT

ACAACCGACGCATTGTTCCACTTTCCCATCATTTTGTTTGCAAACCGCTAAAAGTCTTATTTCCTCATCTC

TTTGACACATTACCAAAGTGGACCCTATGCTGTAATCACACAGGATAATGTTGGAAAGTATGAATATCTAA

ATTATTTTTTAAAGGTATTATTTTTTTCCTTCTGTTTTCAAATCATTTCTGACAGTTTCTAAAGACATGGT

CACAGCTGCCTGAAGCATGTCTTCTTCACTCATAGCATCACCTAGATCACTCCCAAGTGCTCCTGAACTGG

TGGCTGGCCTTTCACATGGATGTGAACTCTGTCCTGATAGGTCCCCCTGCTGCTGCTGCTGCTGCTGCTGT

TGCTGCTTTTGCTGCTGTTTTCTCGTGGAAGATGGACTCCATGTTTATTTGTCTGGAGCCAACGGCCCCCA c

SEQUENCE LISTING (2040 sequences)

SEQ ID NO: 1 - DNA, 6770 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 2 - DNA, 6770 bp, Homo sapiens
tagaaaagcaaacattatctttatttaataatctttgatatttaaaatacaactcattgaacatccacactaacaacagaatcctgtgttcaacagtgctttggaagcccggcttttctaacgaccagacaggaaggcctgtgtgtgtaataacagcaaatgaacttaacgagggagcacacacagaagggctgcagggctgggtcctgagcaagcggcactgccacagtgcacttgtatcatggccaaacaacaatgctttttgtttcagatattttctgtacttgaatttcaaatatttatacagaacagtaatttttaaaaagttattcctaatagcccagtgttgtaaaaattagataatcacatttaaaaatgtatgttttcctctttcaaaaaaaaaaaaagcattaaaaaaattcagaaaacattccttgaactatgcaagagacaattgagagcttcctaaatgcatcaggaatatccatttatattttactaatgtttctcattgctttgtctatgaatccacaggcttaaaatgttttttgatatgctattaaacatgccaattacgacaaatttagaagttacgttattagcactaattcttaaaatgccagaccacttggaaaaaataataatagcaaagattttcttcaaattaaaaaacaaaatcaaaattctagaatttaccaacgatgtcaataatcttcactcatgaaagcaaattagaacaaaaatatttttattatgtttaagactaaaaaaatacaaagccaggtcattttttaaagcaaaaagatgctggttataaaggggccagaaataaaagaaagtttttattttgaatatgaaaaataaagttatttacattgctgacatgattagttgatccaatctggtagttcttaattagggtcacatatatatccatacttaaggactcgatacaacaaacaattcactttgaaaacagtggcccaaggccgggtgtggtggcctgcacctgtaatcccagcactttgggaggccaaggcaggcagatcacctgaggtcaggagtttgagaccagcctaacatggtaaaagcccgtctctactaaaaaaaacaaatattcgccaggtgtagtggcaggtgcctgtaatcccaggtacttgggaggctgaggcaggagaatcgcttgaacccaggaggtggaggttgcagtgagccaacatcgtgtcattgtactccagcctgggcagcagagctagactccgtctcagaaaaaaaaaaaaagaaagaaagaaagaaagaaaaagaaaatagcggcccaacgcctcttcgtttccggattaaaaaaaaacaaacaaacctttaagatggagttttactcttgttgcccaggctagagtgcaatggcacgatctcagctcactgcaacctccacctcctgggtttaaacgattctcctgcctcagcctcccaagtaactgggattacaggtgcccgccaccatacctggcttaagttttgtatttttagtagagatggggtttcaccatgttggccaggctggtctcaaactccggacttcaggtgatccacctgcctcagcctcccaaagtgttgggattacaggcgtgagccactgcccccgactgggataaagtttttaataggaagtcatatatatatacatatatatatacacacatatatatatatatatatatatttttttttttcagaaacagtgtctcactctgttgggcaggctggaatgcagtggtgagcccttggcactctgcaacctctgcctcctaggctcatgcgattcttagcctcctgagtagctgggattacaagtgtgtgcaaccacgcccggctaatttttgtatttttagtagaaacgaggtttcaccatgttgcccagactggtcttgaactcctggcctgaagtgattcgcccacctcagcctccagaactgctgggattacaggcgtgagccactgcacccagccgggagatcatcaatattaactattgaatcctcgtaagaatttaaaacatcaagatttatttttctacttaagattttaaaattatcatattttgattatgcactgaatctattttttatctgtacaggtccaatgggccggttttaagaatttagtagctcttggcactagcatgattttttttttttttttgagacagagtctcactctgtcgcccagtctggagtacagtggcaccatcttggctcactgcatcctctgtcgccagggttcaagcaattctcctgcctcagactcccaggtagctgggattacaggcacctgccaccgcgcccagctaatttttgtagtttttagtacagatggggtttcaccattttggccaagctggtctcgaactcccgacctcgtgatccacccacttcggcctcccaaaatgctgggattacaggcgtgagctaccacgcccagccgccactagcatgattttaaaaatagtatcaaaaattcagacaatcaaaatgtgatttaggctctgactgaaataaaatttattttattcaacttaatattaaacaatatggactactggtagttttgtctgcaatgatactcaactggttttgagtttttttcctcatttactttggcatcatgaataaagttaagaaaaatcaagttttaaggacaaaaaaaaaaagcaccaccttaaataaaatattctgtgaattgtaaattatttggccaagatcctagtatagagtttacctgcagcagccttttcaaacagtttatattactgaaatatttacatgattaccgtaaaaaacatagattgatggttttagatcagagattaactattctgaattttaaaaacataaattactcattaaatccatgacatctgaaaatatgaaagtggtatttccaaggcttaaacttctactagcatcaccactgtacatacttgatcccagtaatacaaattatacattagaaaaatgataccaatagtttaaatattaaacattaagatgttcccaattagtaaaacaaaatggaaatctttaatacacttcttagcaggacagttcttgtgaatttagttgttcctgactttcttgcaggtggtttacagtaaatggcagtacctgatgtataaactatagctttgaataatttttaacttttttgatactatggttacttgcactggcatcttttcatactggccaatcaattaagaaatggaatctaaacagtcaattaaatttaagccaaccccaccaagatgacagttcactagtgcttctggatctgcctgctaaatgtaacaatttcacaacaaactacacaaacacattcaaacgcatccagtgtgtgctcagctctgctttaaaaactctctagctggccaggcgcagtggctcatgcctgtaatcccaacactttgggaggccaaggcaggcggatcacctgaggtcaggagttcgagaccagcctggccaaacatgatgaaaccgcgtctctaccaaaaatacaaaaatctgccgggtgtggtggtgggcgcctgtaatcccagctactctggaggctgaggcaggagaattgcttgaacccgggaggtggaagttgtagtgagccgagatcatgccactgccctccagcctgggagacatagcaagactccgtctcaaaaaaaaacaaaaacaaaaacaaaaactctctaggaactaaaagtcaaacatgccatattttcttaagtgctttaactagggtatatatgaactttataaactctaaagttaaaactttaaaatgcatattggttttctcatttttatattaggtagctcatcaattcaagtgtatgaaaagtttaatgtaacttttcaatggaaaaaggtaatgaacaaatatccatggaaaatatgacaaacacactggtaataattaacataaatgttcagtcttaaaatatttagctttttaaatcttgagggagtagtactaaactccaacatcccttgcagttttaaagttttataattcttctgaaacatttttaactattaaaagaaactttagattttaaaataaagctatccttttgtgtaagggaaacttcagaaaactgattggcacaaaataatgacttaaaaaatctgttatatcgaagaaaaagctattttataatcataaataaaagatattttttcttctcttttcagttagttagcaataaatcctagatcaaaaaactttccctgataaaatgtgtgcagccacacaccaggagggcaatataccatattataattttcgaagttgtcagctgaaatttcttggattttagcttatgaacaattcaacattcaaaagagcttcaaaaggagatggagaatgagggatagggaacactgaaactaaaacatcaatttcagagacatggttttcaccaaaatgatactatcctattgacccagcaagaaactctctgtacatctcaattaaagagaatatttatcaaaactatggactttcttatttatagatccactaagtactgtgacttccattgttcttaagctatctaaacatgatgcaagtgtcaaatcacagtataaatttaaacatattttcattagtaaattattttcatgttccagatcaccatctttgacaagctatacctactaaaagatgtgaagcagacacctacattccatgactcaactgtaaagagaacacaaagctccagtcataggagaaaaaataaaataaaactgctattaaaattgaaggccaaatttcatgtatcatacattcatggtgggtacgtatgtttagtcttctaacagaaggagacttgcctgcatactatgcttctcctagttttctcaattggagaagaaaggaaaaaataaggcgcaggaagaaggggttgcaacaaagctgtaaggttttgatataagtgaaaagacattcataaagcatctgggaaagcacatgctcacacattttaaaaaatgctcatttattctcaagtacttgtgcaaggctgatttcagagtttaggaacgcaccagtcatgaaataatgatcccatcgtagggcttaaaacgctaaacctcagaaaagattaccatctttcaaaagaattgtgggaaaataatgaaaaccaggtagcagaaaagttgtgatcagagaaaacaacacaagaaaacactggagcacacggtatacagttgaagggagaactgttcatccttctagaaccattactattatcaacatcaggaaagtagagatactttcctgaaaggttaatttggttaataagaaatgaaagccactattacatgatgtgagccaacttacctacaagacagaaaaagaaaacaaactatatggaaaaagcctgaggcgagagctaattagctagtctgcaaaaagatccaagaaaaatgccctaactttagacatgttacatattgcacactcaaaaaagaaaaagaaacatttagaaaactattttaaatgtctttaattgctgaatgcctctttggctaatatttggaagatcattatttagtcctacaaccgacgcattgttccactttcccatcattttgtttgcaaaccgctaaaagtcttatttcctcatctctttgacacattaccaaagtggaccctatgctgtaatcacacaggataatgttggaaagtatgaatatctaaattattttttaaaggtattatttttttccttctgttttcaaatcatttctgacagtttctaaagacatggtcacagctgcctgaagcatgtcttcttcactcatagcatcacctagatcactcccaagtgctcctgaactggtggctggcctttcacatggatgtgaactctgtcctgataggtccccctgctgctgctgctgctgctgctgttgctgcttttgctgctgtttttcaaagtaggcttctcgtctcttccgaagctcttctgaagtaagatttgtacctgatgtctgtgtcatatcttgagatatgtttctggaactaccttgcatacttagctgaatagccctgcggagatctgcttcctcatcttccatgtcaatttcttggcgacttagtgccagagccctctgcaaatcctcctcatcttcgtctaacattcctgagccatcatttgcttctaacactcgttccaggtctgttttatggactctttgctcttttagttgtgctaattcttctccaataagttttggtcgatgcatctgttggaccctaatcatctgcaggagttggtcagcttcgcaatctggcagatcacccttaacgacaaatatagaataaccttcctgttgtaattgagccaagaaaagtgcaagatatgtatctgatattaattctggacccgtcaagagagaattcaagttaaaccactgaatagagaaaaaaccactgtcatccatatttccagaaggctgctgtaaaaacgtgcgataatcttcactagtaactcctccttctgccattctcatcctctcctcctcatccagctgatgtgcaattgaggataattccacagggctaaaatattctccttgcaataagttattcaggcaatgttgagcacaaagtgagccttcttgtttctcgtggaagatggactccatgtttatttgtctggagccaacggcccccacgccgaaccaccccctccagctccgccccctgcccctctc

SEQ ID NO: 3 - DNA, 1987 bp, Macaca fascicularis
ggggtggttcggtgtgggggccgttggctccagacaaataaacatggagtccatcttccacgagaaacaagaaggctcactttgtgctcaacattgcctgaataatttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagagttaatatcagatacatatcttgcacttttcttggctcaattacaacaggaaggttattctatatttgttgttaagggtgacctgccagattgcgaagctgaccaactcctgcagatgatcagggtccaacagatgcaccgaccaaaacttattggagaagaattagcacaactgaaagagcaaagagtccataaaacagacctggaacgagtgttagaagcaaatgatggctcaggaatgttagatgaagatgaggaggatttgcagagggctctggcactaagtcgccaagaaattgacatggaagatgaggaagcagatctccgcagggctattcagctaagtatgcaaggtagttccagaaatatatctcaagatattccacagacatcaggtacaaatcttacttcagaagagcttcggaagagacgagaagcctactttgaaaaacagcagcaacagcagaagcagcagcagcagcagcagcagggggacctatcaggacagagttcacatccatgtgaaaggccaaccaccagttcaggagcacttgggagtgatctaggtgatgctatgggtgaagaagacatgcttcaggcagctgtgaccatgtctttagaaactgtcagaaatgatttgaaaacagaaggaaaaaaataatacctttaaaaaataattgagatattcatactttccaacattattctgtgtgattacagcatagggtccactttggtaatgtgtcaaagagatgaggaaataagacttttagtggtttgcaaacaaaatgatgggcaagtggaacaatgcgtcagttgtaggactaaataatgatcttccaaatattagccaaagaggcattcagcaattaaagacatataaaatagttttctaaatgtttctttttcttttttgagtgtgcaatatctaacatgtctaaaattaggggcatttttcttggatctttttgcagaccagctaattagctcttgcctcaggctttttccagttttctttttctctcttgtagataatttggctcacatcatctaatagtgactttcatttcttattaaccaaattaacctttcaggaaagtatctctagtctgtgttgataatagtaatggttctagaaggataaacagtcctcccttcaactgtatactgtgtgctccagtgttttcttgtgttattttctctgatcacaacttttctgcgacctggttttcattattttcccacaattcttttgaaagatggtaatcttttctgaggtctagcattttaagtcctgtgatgggatcattatttcatgactggtgcattcctaaactctgaaatcagccctgcgcaagtacttgagaataaatgagcgttttttaaaatgtgtgagcatgtgctttcccagatgctttcccagatgctttatgaatatcttttcacttacatcaaaaccttacagctttgttgcaaccccttcttcctgcgccttattttttccttctccaattgagaaaac

SEQ ID NO: 4 - DNA, 1987 bp, Macaca fascicularis
gttttctcaattggagaaggaaaaaataaggcgcaggaagaaggggttgcaacaaagctgtaaggttttgatgtaagtgaaaagatattcataaagcatctgggaaagcatctgggaaagcacatgctcacacattttaaaaaacgctcatttattctcaagtacttgcgcagggctgatttcagagtttaggaatgcaccagtcatgaaataatgatcccatcacaggacttaaaatgctagacctcagaaaagattaccatctttcaaaagaattgtgggaaaataatgaaaaccaggtcgcagaaaagttgtgatcagagaaaataacacaagaaaacactggagcacacagtatacagttgaagggaggactgtttatccttctagaaccattactattatcaacacagactagagatactttcctgaaaggttaatttggttaataagaaatgaaagtcactattagatgatgtgagccaaattatctacaagagagaaaaagaaaactggaaaaagcctgaggcaagagctaattagctggtctgcaaaaagatccaagaaaaatgcccctaattttagacatgttagatattgcacactcaaaaaagaaaaagaaacatttagaaaactattttatatgtctttaattgctgaatgcctctttggctaatatttggaagatcattatttagtcctacaactgacgcattgttccacttgcccatcattttgtttgcaaaccactaaaagtcttatttcctcatctctttgacacattaccaaagtggaccctatgctgtaatcacacagaataatgttggaaagtatgaatatctcaattattttttaaaggtattatttttttccttctgttttcaaatcatttctgacagtttctaaagacatggtcacagctgcctgaagcatgtcttcttcacccatagcatcacctagatcactcccaagtgctcctgaactggtggttggcctttcacatggatgtgaactctgtcctgataggtccccctgctgctgctgctgctgctgcttctgctgttgctgctgtttttcaaagtaggcttctcgtctcttccgaagctcttctgaagtaagatttgtacctgatgtctgtggaatatcttgagatatatttctggaactaccttgcatacttagctgaatagccctgcggagatctgcttcctcatcttccatgtcaatttcttggcgacttagtgccagagccctctgcaaatcctcctcatcttcatctaacattcctgagccatcatttgcttctaacactcgttccaggtctgttttatggactctttgctctttcagttgtgctaattcttctccaataagttttggtcggtgcatctgttggaccctgatcatctgcaggagttggtcagcttcgcaatctggcaggtcacccttaacaacaaatatagaataaccttcctgttgtaattgagccaagaaaagtgcaagatatgtatctgatattaactctggacccgtcaagagagaattcaagttaaaccactgttttcctaattttctaactgtaaaccagtgttccttataattgcatataaatgatctttcatttataggatcgatcctgagcctctgatactctggactgttgaacaggattagttctaaaccccaaactttcaaggcattgcttataacctgaatagagaaaaaaccactgtcatccatatttccagaaggctgctgtaaaaacgtgcgataatcttcactagtaactcctccttctgccattctcatcctctcctcctcatccagctgatgtgcaattgaggataattccacagggctaaaatattctccttgcaataaattattcaggcaatgttgagcacaaagtgagccttcttgtttctcgtggaagatggactccatgtttatttgtctggagccaacggcccccacaccgaaccacccc

SEQ ID NO: 5 - DNA, 5376 bp, Mus musculus
ggaccggggctgaggggtggggccgggggcggagctgctggagggggctgctccgcgccggggccgttggctccagacaaataaacatggagtccatcttccacgagaaacaagaaggctcactttgtgctcagcattgcctgaataacctattgcaaggagagtattttagccctgtggagctatcctcaattgcacaccagctggatgaagaggagaggctgagaatggcagaagggggagtcactagtgaagactaccgcacatttttacagcagccttctggaaatatggatgacagcggctttttctctattcaagttataagcaatgctttgaaagtttggggtttagaactaatcctgttcaacagtccagagtaccagaggctcagaattgatcctataaacgaaagatcctttatatgcaattataaagaacactggtttacagttagaaaattaggcaagcagtggtttaacttgaattctctgttgacgggtccagaattaatatcagatacatacctcgcactattcttggctcaattacagcaagaaggttattctatatttgttgttaagggtgatctgccagattgtgaagctgaccaacttttgcagatgatcaaggtccaacagatgcatcgaccaaaacttattggagaggaacttgcacatctgaaagagcagagtgccctcaaagcagacctggagcgcgtcttagaagcagctgatgggtcgggcatatttgatgaagatgaggatgatttacagagggctctagccataagtcgccaggaaatcgacatggaggatgaagaagctgatctccgcagggccattcagctcagtatgcaaggtagttccagaagtatgtgtgaaaatagtccacagacatcaagtccagatctctcttcagaagagctgcggaggagacgagaagcctactttgaaaagcaacagcagcagcagcaggaggtagaccgacctggacccctttcatatccacgtgaaagaccgaccacaagttcaggaggacgtaggagcgaccaaggaggcgacgctgtgagtgaagaggacatgcttcgggcagctgtgaccatgtctttagaaactgctaaagacaacttgaaagcagaaagaaaaaaatagtacctttaaaagtcattttgctactcacactttgtaacattgtctgtgtgattacagtgtaagggccactttggcagtatgttcaccagaagagataaagacactgtagtggtttgtaagcagaaaggcagaaatgtgtcataggactaaggaacgatcgagatactagccaaagaggcagtcagcaatgaaagaaacttttctaaatgtcccgttttgtttttcaaatgtgcaatatctgactgaaattatggaatttttgttggctcttttggaccaactgattagctcttgccacagaacttgatcctataatgtttcgttttctctctgcattgggggtggcttggctcacttgagcttttacttcatttcagacctaccttttatgaaatgtcttttatatgtcttgttacagaaagatcagtctgtcttctcatacatatgtcgggcacgtggatgcttcctggtggtattttctctaatgtggtgatgtgttgcttttaaagcctttgttagtgggatcacatttcctaattgtgctgcattcctctactctgcagtcagctctgttcttgtaactgagcacgtgagcgtgctctgtctggatgccctgagagtggctgactcctggctggagcccttcctgtaccttccttcctctcttctccagctgagaaaagaggaggcagaggacacaaacagatttccttctacgtaacatgcaccatgaatgcaccacaggagaaactcgcccttcagtcctggtggtgggtttgtcctagtttttcatctgtgacaggagctttgtgttctaatcacgattaagtcctggaaaatagatgcctgcttcactttctaaaaattaaaaatatttttttttctttttctagtagaaaataggctgctaggatgatggtctagaatctgaaagtaatttactaataaaatatatttaaataatactgtgggttgacccttgcaatcatgtttaaatcgcttaagaattacagaagtcacaaagcttaaagggtctgtttgtaaataggaaagtccttagttttgataaacattaagcaggatgcagagctagtcttgctgggtcaatacgtggtatgatttgggtggaaattaactctgtgtctttgtcatggtgtcatagataccctgatacctgctttcccctccctcccctttgaagcccctttgaatggtgacttgtacataggtaaagtccaagaagagattgtagccagcttaggaaggggcagcatgctatagtgctctactggtgtgtgctctgcacacgtttttatcagggaaagttttggatgtaggatttattgctgtctaactgaaaaagatacaaatatttttatttatgcttatgaaatagctttttcttgataggatggatgtttggtttggtttggttgtgcgagggattgaacccagggcctccagtgtgctaggcaagcgccctacctctgagctatatccccagatccagaacaggggtttccttgtttgctttttgttgtttttcttagccattttgtgccaactacagttgttttttaaaaatttgcttcatgaaaaattaggcagtcctattttaaaatctatgaagttttctttcagtaattgcaaaggttcagaagagttgggcagctgtagggtgttagagttaggactttgcttacagttgattgctatactgaagtatgtaactactcccgtatgctgctcacatgtctagacattcattggcccttttcctttaccctttgaaaaatcacattaaactttccatacatttagattggtgtgctgcctgatgaaaaatgagaaagccaatatacacttcagctttaactttagagtttataaaatgttcatataacacaccctacttaaatcatgtatgaaatacagcatgttagtcttttattagaaatgttttaaagagaaactgagcacacactgaatctatttgagtgaagctttttagtttgttatatttatggcattgtccaggcagatccaaaatcaccattgaattgccatcctctttgggttgacctaggcttactaaacatttagatttcattattaatgagtagccagtatgaaaagatgccaatgcttattctagccacagtatccaaagtgtaggagttctatgacattctaattcataaccaggagttgctgtttatagtactgcaggacagacaggggcaagggactccactgccacggctggtcacagactcgactaacttttccatttgtttttttaccaattggaatacttaaatgtattgtatgtaatgaatactaaactactgataatcattttttttaaatctgtaacttgttctgccagataaaatgcgtacagccgtgatgctagtgttataaccaagtgtaaggaccctttggaaggccagacatggtgctgtgttcctttgatgctggtacttaggagaaatctgcagaggtaggcagatttcttcttgagttcaaggccagcctggtctacatagtaagttccagactttctggagctgcacagtaagaccctgtcttaaacaaaaaacaaacaaaccaacctttggaaagatcactttcatattttgggatgtcatgagcttatctatgtttcaaaattcagaatagctgtcctttggcctaaaccataaatctacacccccaacgacagtactatgcagacatttcactgatttaagttgtttgatacagtcagtgcaggtgaactccatgctaaagttttaagccttggccaaataacttacacctcacagactgtctgaggcggtgcttctttttttcctgaaaacttgatttttcttgatgaagccaaagttaatgagcatgaattctcaaaggagtagtctgctttgttttacttaatatcaggttgagtgaagtaagttttattcgtgtcagagtctaagccacacattttgaatacccacatgtttgatactatttaagtcatgctgtgccaagagttactaaattcttagaactggccctgtgccctgcctaaggccagacagggcagtgcggaacccaaatgtgctatctgagagtcttaagctaggaaatctgggtgttttaaattagtgagaggtttcagttagtgttgaaacctccagatccgacttgatgttaggcagtgtggatgtgctcagtggtagagcagttacctagtggcccaggccttgggttcagtctctaacactgcaaaaggagagcagtggctcacagtgtaacctacgtttagagagacatgaaaggaagtactttcaaagtgaatgtttgttgtaatttagtcctaacaagtgtagagctatgatatgtgaccttaattaagaaaaaccagattggatcagtagtatttttgttgtttttcatatttaacataaaaattcccttcatccctaatttgtttataattaaagagacaaattgattttgtattttttcaaagttttatacatattaaaagggttttgttgtagtctatcatgaatgaaaaggatatttttttttttaatttgaggaatacttttgtgtgtgtgtgcctaaaatggtctgtcattttaagaattagcacaaaaaaaaaattagctagttcctaaatgtatggaggtttaatagtaccagtacacagttgtgggtgaggcactagtgagaagtgtgtgggaaatgcagctgggtaggtgggactcacttgtctctgaatggtttaaaggtggtatttcctggaatttttttaatgattttttttttcaaggaagacagacattcgaaatgtgcttatcaaatttctacaacactggactaataggaataactttttttttaaaaaaaaaagactgttctgtataaataaaatatatgaaactcaagtgcaaaagccgtgaaaataaaaggcattgtcttctgtcaatgtgatgcactgtggccgagcagttccctcaggactcaactctgcagcccttcctcctgtgcctcaagtgtcggctgccactccacaggtcttccgtctgtcggctcctttgaaagccgggcttccaaagccctgttgaacactgagggttctggtgatgtgtgttaatgagttgtattttaaatatcagagattattaaataaagagaatgattttctattaaaaaaaaaaaaaaaaaa

SEQ ID NO: 6 - DNA, 5376 bp, Mus musculus
ttttttttttttttttttaatagaaaatcattctctttatttaataatctctgatatttaaaatacaactcattaacacacatcaccagaaccctcagtgttcaacagggctttggaagcccggctttcaaaggagccgacagacggaagacctgtggagtggcagccgacacttgaggcacaggaggaagggctgcagagttgagtcctgagggaactgctcggccacagtgcatcacattgacagaagacaatgccttttattttcacggcttttgcacttgagtttcatatattttatttatacagaacagtcttttttttttaaaaaaaaagttattcctattagtccagtgttgtagaaatttgataagcacatttcgaatgtctgtcttccttgaaaaaaaaaatcattaaaaaaattccaggaaataccacctttaaaccattcagagacaagtgagtcccacctacccagctgcatttcccacacacttctcactagtgcctcacccacaactgtgtactggtactattaaacctccatacatttaggaactagctaattttttttttgtgctaattcttaaaatgacagaccattttaggcacacacacacaaaagtattcctcaaattaaaaaaaaaaatatccttttcattcatgatagactacaacaaaacccttttaatatgtataaaactttgaaaaaatacaaaatcaatttgtctctttaattataaacaaattagggatgaagggaatttttatgttaaatatgaaaaacaacaaaaatactactgatccaatctggtttttcttaattaaggtcacatatcatagctctacacttgttaggactaaattacaacaaacattcactttgaaagtacttcctttcatgtctctctaaacgtaggttacactgtgagccactgctctccttttgcagtgttagagactgaacccaaggcctgggccactaggtaactgctctaccactgagcacatccacactgcctaacatcaagtcggatctggaggtttcaacactaactgaaacctctcactaatttaaaacacccagatttcctagcttaagactctcagatagcacatttgggttccgcactgccctgtctggccttaggcagggcacagggccagttctaagaatttagtaactcttggcacagcatgacttaaatagtatcaaacatgtgggtattcaaaatgtgtggcttagactctgacacgaataaaacttacttcactcaacctgatattaagtaaaacaaagcagactactcctttgagaattcatgctcattaactttggcttcatcaagaaaaatcaagttttcaggaaaaaaagaagcaccgcctcagacagtctgtgaggtgtaagttatttggccaaggcttaaaactttagcatggagttcacctgcactgactgtatcaaacaacttaaatcagtgaaatgtctgcatagtactgtcgttgggggtgtagatttatggtttaggccaaaggacagctattctgaattttgaaacatagataagctcatgacatcccaaaatatgaaagtgatctttccaaaggttggtttgtttgttttttgtttaagacagggtcttactgtgcagctccagaaagtctggaacttactatgtagaccaggctggccttgaactcaagaagaaatctgcctacctctgcagatttctcctaagtaccagcatcaaaggaacacagcaccatgtctggccttccaaagggtccttacacttggttataacactagcatcacggctgtacgcattttatctggcagaacaagttacagatttaaaaaaaatgattatcagtagtttagtattcattacatacaatacatttaagtattccaattggtaaaaaaacaaatggaaaagttagtcgagtctgtgaccagccgtggcagtggagtcccttgcccctgtctgtcctgcagtactataaacagcaactcctggttatgaattagaatgtcatagaactcctacactttggatactgtggctagaataagcattggcatcttttcatactggctactcattaataatgaaatctaaatgtttagtaagcctaggtcaacccaaagaggatggcaattcaatggtgattttggatctgcctggacaatgccataaatataacaaactaaaaagcttcactcaaatagattcagtgtgtgctcagtttctctttaaaacatttctaataaaagactaacatgctgtatttcatacatgatttaagtagggtgtgttatatgaacattttataaactctaaagttaaagctgaagtgtatattggctttctcatttttcatcaggcagcacaccaatctaaatgtatggaaagtttaatgtgatttttcaaagggtaaaggaaaagggccaatgaatgtctagacatgtgagcagcatacgggagtagttacatacttcagtatagcaatcaactgtaagcaaagtcctaactctaacaccctacagctgcccaactcttctgaacctttgcaattactgaaagaaaacttcatagattttaaaataggactgcctaatttttcatgaagcaaatttttaaaaaacaactgtagttggcacaaaatggctaagaaaaacaacaaaaagcaaacaaggaaacccctgttctggatctggggatatagctcagaggtagggcgcttgcctagcacactggaggccctgggttcaatccctcgcacaaccaaaccaaaccaaacatccatcctatcaagaaaaagctatttcataagcataaataaaaatatttgtatctttttcagttagacagcaataaatcctacatccaaaactttccctgataaaaacgtgtgcagagcacacaccagtagagcactatagcatgctgccccttcctaagctggctacaatctcttcttggactttacctatgtacaagtcaccattcaaaggggcttcaaaggggagggaggggaaagcaggtatcagggtatctatgacaccatgacaaagacacagagttaatttccacccaaatcataccacgtattgacccagcaagactagctctgcatcctgcttaatgtttatcaaaactaaggactttcctatttacaaacagaccctttaagctttgtgacttctgtaattcttaagcgatttaaacatgattgcaagggtcaacccacagtattatttaaatatattttattagtaaattactttcagattctagaccatcatcctagcagcctattttctactagaaaaagaaaaaaaaatatttttaatttttagaaagtgaagcaggcatctattttccaggacttaatcgtgattagaacacaaagctcctgtcacagatgaaaaactaggacaaacccaccaccaggactgaagggcgagtttctcctgtggtgcattcatggtgcatgttacgtagaaggaaatctgtttgtgtcctctgcctcctcttttctcagctggagaagagaggaaggaaggtacaggaagggctccagccaggagtcagccactctcagggcatccagacagagcacgctcacgtgctcagttacaagaacagagctgactgcagagtagaggaatgcagcacaattaggaaatgtgatcccactaacaaaggctttaaaagcaacacatcaccacattagagaaaataccaccaggaagcatccacgtgcccgacatatgtatgagaagacagactgatctttctgtaacaagacatataaaagacatttcataaaaggtaggtctgaaatgaagtaaaagctcaagtgagccaagccacccccaatgcagagagaaaacgaaacattataggatcaagttctgtggcaagagctaatcagttggtccaaaagagccaacaaaaattccataatttcagtcagatattgcacatttgaaaaacaaaacgggacatttagaaaagtttctttcattgctgactgcctctttggctagtatctcgatcgttccttagtcctatgacacatttctgcctttctgcttacaaaccactacagtgtctttatctcttctggtgaacatactgccaaagtggcccttacactgtaatcacacagacaatgttacaaagtgtgagtagcaaaatgacttttaaaggtactatttttttctttctgctttcaagttgtctttagcagtttctaaagacatggtcacagctgcccgaagcatgtcctcttcactcacagcgtcgcctccttggtcgctcctacgtcctcctgaacttgtggtcggtctttcacgtggatatgaaaggggtccaggtcggtctacctcctgctgctgctgctgttgcttttcaaagtaggcttctcgtctcctccgcagctcttctgaagagagatctggacttgatgtctgtggactattttcacacatacttctggaactaccttgcatactgagctgaatggccctgcggagatcagcttcttcatcctccatgtcgatttcctggcgacttatggctagagccctctgtaaatcatcctcatcttcatcaaatatgcccgacccatcagctgcttctaagacgcgctccaggtctgctttgagggcactctgctctttcagatgtgcaagttcctctccaataagttttggtcgatgcatctgttggaccttgatcatctgcaaaagttggtcagcttcacaatctggcagatcacccttaacaacaaatatagaataaccttcttgctgtaattgagccaagaatagtgcgaggtatgtatctgatattaattctggacccgtcaacagagaattcaagttaaaccactgcttgcctaattttctaactgtaaaccagtgttctttataattgcatataaaggatctttcgtttataggatcaattctgagcctctggtactctggactgttgaacaggattagttctaaaccccaaactttcaaagcattgcttataacttgaatagagaaaaagccgctgtcatccatatttccagaaggctgctgtaaaaatgtgcggtagtcttcactagtgactcccccttctgccattctcagcctctcctcttcatccagctggtgtgcaattgaggatagctccacagggctaaaatactctccttgcaataggttattcaggcaatgctgagcacaaagtgagccttcttgtttctcgtggaagatggactccatgtttatttgtctggagccaacggccccggcgcggagcagccccctccagcagctccgcccccggccccacccctcagccccggtcc

SEQ ID NO: 7 - DNA, 5240 bp, Rattus norvegicus
gggggcggagctgctggagggggctgctccgcgccggggccgttggctccagacaaataaacatggagtccatcttccacgagaaacaagaaggctccctttgcgctcagcattgcttgaataacctcttacaaggagagtattttagccccgtggagctgtcctcaattgcacaccagctggatgaagaggagaggctgcggatggcggaaggaggggtcaccagcgaagactaccgcacatttttacagcagccttctggaaatatggacgacagcggctttttctctattcaagttataagcaatgccttgaaagtttggggtttagaactaatcctattcaacagtccagagtaccagaggctcagaatcgatcctataaatgaaagatcctttatatgcaattataaagaacactggtttacagttagaaaattaggaaaacagtggtttaacttgaattctttgttgactggtccagagctaatatcagatacatacctcgcactgttcttggctcagttacagcaagaaggttattctatatttgttgttaagggtgatctgccagattgtgaagctgaccaacttttacagatgatcaaggtccaacagatgcatcgaccaaaacttattggagaagaactcgcacatctgaaagagcagagcgccctcaaagcagatctggagcgagtcttagaggcggctgacgggccgggaatgtttgatgatgatgaggacgatttacagagggctctggccatgagtcgccaggaaatcgacatggaggacgaagaagccgatctccgcagggccattcagctcagtatgcaaggtagttccagaggtatgtgtgaagatagtccgcagacatcaagcacagatctttcttcagaagagctgcggaagaggagagaagcctactttgaaaagcaacagcatcagcaacaggaagcagaccgacctggatacctttcatacccatgtgaaagacccaccacaagttcaggaggactccggagcaaccaaggcaatgctatgagtgaagaggacgtgcttcgggcaactgtgactgtgtctttagaaactgctaaagacagtttgaaagcagaaagaaaaaaatagtccctttaaaaatcattttgccaccatgctttgtaacattgtttgtgtgatcacagtgtaaggtccactttggcagcagtgtgttcaccggaaggcagcagacactgcatggtttgtaagcagaaagggcagaagcgtcctaggactaaagaaccacgagatgctagccaaagaggcagtcagcaatgaaagaaacaacgtagttttctaaatgtccctccttgtttttcaaatgtgcaatatctgactgaaattatggaattttccttggctcttttggaccaactcgttagctcttgccacagaacttgatcctgtagagttccgtcttctctctgcattggagctggcttggcttgtttgggcttttcttcatttcacaccaaccttttgtgaaatatcgtttgtatgtcttgctatggaaagatcagtctgtcttttcgtgtatgtgtcaggcacatggatgcttcctggtgttattttctctggttttggttattttcctgcaagtctaacatggtgatctgttggttttaaagccttttttagtgggatcattatttaactctggtgcattcctctactctaaagtcagccctgttcttctaaacgagctgaggttttttgtgagcacgtgctttctcgatgccctgcgaaggatttcagctgtgtcctggctgacttatttcctttcttttccagttgagaaaggagagacagaggatacaaatatatttccttctacttaacgttctccatgaatgtaccacaggagaacccgcccttcagtgctggtggtgggttcgttccagtgtttcttctgtgtcaagagcttagtgttctgtatatgattaagtcctggaaaataggtgcctgcttcactttttaatttttaaaaataaatttttttttattttagtagaaaataggctgctaggatgatggtctaggatgtgaaagtaatttactaatgaaaatatatttaaatatactgtggttgacccttgctaccatgttaaaattgttaagaattacagaagtcacaatacttaaaggatctgtttgtaaatacgaaagtccttagttttgataaacattaagtgagatgcacatctggtcttgctgggtcaatgctttggtatgatttgggtggaaattaactatgtgtgtttgtcctgggtgtcatagatcctgatactgttttcccctccctaccctttttgaagcccctttgaatgttaacttgtacataggtaaaatcaagaagaaattttagccaacagcttagtaaggtgaagcatggtatattgctctactgatgtgtgttctgcacacgtttttatcagggaaagtttttgatgtaggatttattgctatctaactgaaaatgatacaaatatttttatttatgattatgaaatagctttctcttggataggatggattgttttgtttggctgtgctagggattgaacccagagcctcgtgtgtgctaggtaagcgctctacctctgagctagatccccagatccaaaacatgtgtttctcttttgtttgttttttttcttagccattttgtgccaattacagtttctctttttgaaatttgcctcatgaaaaattagacagtcctattttcaaatctatgaagttttcttttagtaattgcaaaggttcagaattatgcagctgtaggctgttgggttaggcctttgcttacagtggatttttacactgaagtatgcagctaccccaagtgtgctggtcacatgtcgagcattgaccctttcctttaccctttgaaaaaccacattacactttccgcacactcagattgatgtgctgcctgacagccatttcagttttaacttcagagtttataaaacgttcatgtaacacaccctacgtaaatcatgtatgaaatacagcatgttgatcttttattagaaatgttttaaagagaaactgagtgtacactgaatatatttgagtgcattttttaagtttgttataaattgtggtatttgtccaggcaaatccaaaatcaccattgaactgccatcccttctattgacctaggcttacctaaacatttagattcattattaatgagtaggcagcatgaaaagatgccaatgcttattataaccacagtatccaaagtgtaagagttgtatgacattcacgtccgtacacaggagctgctgtttacagtactgcaggatagatgggccagggactccgctgtcatggtcctgttatggacttaactgacatttccattctgtttttaccaattggaatactttaatgtttaatatttaaactactgataccatttttctaatgtgtaacttatactaccaaataaaatatgtacagccagaatgctagtgttagaaccaagagtaggaaccctctggagaccaggcatggtgctacatgccttcaatccccgtgcctgggagtcagaggcaggcagattgctttttgagttcaaagccagtctagtctacagagtaagttccaaacttgctgcagctgcatagtaggactctgtctttaaaacaaaacaaaacacaacacaacacaacacaacaaaaacctttgggacatttcattgattagatggtttgatacagtcagtgcaggtgaactccacggtgaagttttaaatgttggccaaataatttacacttcacagactatctgaggcggtgcttttttttttttcctgaaaacttgatttttcttgatgaagccaaagttaatgaggatgaattctcaaaaggagtagtctgcattgctttatttaatatcaggttgagtaaaataagttttattcatgtcagagtctaagccacagattttgaatacctgaatgtttggtactatttaaatcatgccagtgccaagaattactaagttcttagaactggcccctgtgccatgcctgagtccagattgggcagtgcagaacccagatgtgctatccgagagtctgaagctggggagtctgatgttttagtcaggaagaggcttcagttaataccgaaacctccagagacaggttattgtcaggcagtgccatgtgctcagtggtagagcagccacctagaggcccaggccttgtgctcagtccctaacactgcaaaagaagaacaggggctcacagtgaatccacgttcagagaggccttacagggagtattttccaagggagttgtttgttgtagtttagtcctaacaagtgtagagctgtaataggtgaccttaagaaaaaccaggtggcatcagctaatcagtacagagttttttggttttcatatttagaaactctccctttattcctaattcgtttataattaaagacaagaattggttttgtatttttcaaagttttatgcataataaaatgttttgttgtagtctttcaggaatgaaaaggatattgactttttttttaaaatttgaggtgtgtgtgtgtgtgtgtgtgtgcgcacatgtgtgtgtgtgcaagcacctaaaatgggtctgtcattttaagaattagcacaaaaaatatagtccctgttatggaggtttaataataccagtacacattgtaagtgcagtcctaggtgaggcactagtgagaagtgtgtggaaaatgcagttacctaggtaggactcacttgtctcttaagtagtttaaaggtagtatgtttcctggaattttttaatgtttttttttcttttttttgaggaagatagacatttgaaatgtgattatctaatttctataacactggactaataggaataactttttaaaaaatgactgttctgtatagataaaatatattgaactcaagtgcaaaagccatgagattaaaggcattgtcttctggtcaatatgatgcactgtagcggagcagttcctcaggacacaactctgcagcccttcctcctgtgcctcaagttgatggctgccactccacaggtcttccgtctgtctgctcctttgaaagctgggcttccaaagcactgttgaacactgagggtcctgttgatattaatgagttgtattttaaatatcagagattattaaataaagagaatgattttctattaa

SEQ ID NO: 8 - DNA, 5240 bp, Rattus norvegicus
ttaatagaaaatcattctctttatttaataatctctgatatttaaaatacaactcattaatatcaacaggaccctcagtgttcaacagtgctttggaagcccagctttcaaaggagcagacagacggaagacctgtggagtggcagccatcaacttgaggcacaggaggaagggctgcagagttgtgtcctgaggaactgctccgctacagtgcatcatattgaccagaagacaatgcctttaatctcatggcttttgcacttgagttcaatatattttatctatacagaacagtcattttttaaaaagttattcctattagtccagtgttatagaaattagataatcacatttcaaatgtctatcttcctcaaaaaaaagaaaaaaaaacattaaaaaattccaggaaacatactacctttaaactacttaagagacaagtgagtcctacctaggtaactgcattttccacacacttctcactagtgcctcacctaggactgcacttacaatgtgtactggtattattaaacctccataacagggactatattttttgtgctaattcttaaaatgacagacccattttaggtgcttgcacacacacacatgtgcgcacacacacacacacacacacacctcaaattttaaaaaaaaagtcaatatccttttcattcctgaaagactacaacaaaacattttattatgcataaaactttgaaaaatacaaaaccaattcttgtctttaattataaacgaattaggaataaagggagagtttctaaatatgaaaaccaaaaaactctgtactgattagctgatgccacctggtttttcttaaggtcacctattacagctctacacttgttaggactaaactacaacaaacaactcccttggaaaatactccctgtaaggcctctctgaacgtggattcactgtgagcccctgttcttcttttgcagtgttagggactgagcacaaggcctgggcctctaggtggctgctctaccactgagcacatggcactgcctgacaataacctgtctctggaggtttcggtattaactgaagcctcttcctgactaaaacatcagactccccagcttcagactctcggatagcacatctgggttctgcactgcccaatctggactcaggcatggcacaggggccagttctaagaacttagtaattcttggcactggcatgatttaaatagtaccaaacattcaggtattcaaaatctgtggcttagactctgacatgaataaaacttattttactcaacctgatattaaataaagcaatgcagactactccttttgagaattcatcctcattaactttggcttcatcaagaaaaatcaagttttcaggaaaaaaaaaaaagcaccgcctcagatagtctgtgaagtgtaaattatttggccaacatttaaaacttcaccgtggagttcacctgcactgactgtatcaaaccatctaatcaatgaaatgtcccaaaggtttttgttgtgttgtgttgtgttgtgttttgttttgttttaaagacagagtcctactatgcagctgcagcaagtttggaacttactctgtagactagactggctttgaactcaaaaagcaatctgcctgcctctgactcccaggcacggggattgaaggcatgtagcaccatgcctggtctccagagggttcctactcttggttctaacactagcattctggctgtacatattttatttggtagtataagttacacattagaaaaatggtatcagtagtttaaatattaaacattaaagtattccaattggtaaaaacagaatggaaatgtcagttaagtccataacaggaccatgacagcggagtccctggcccatctatcctgcagtactgtaaacagcagctcctgtgtacggacgtgaatgtcatacaactcttacactttggatactgtggttataataagcattggcatcttttcatgctgcctactcattaataatgaatctaaatgtttaggtaagcctaggtcaatagaagggatggcagttcaatggtgattttggatttgcctggacaaataccacaatttataacaaacttaaaaaatgcactcaaatatattcagtgtacactcagtttctctttaaaacatttctaataaaagatcaacatgctgtatttcatacatgatttacgtagggtgtgttacatgaacgttttataaactctgaagttaaaactgaaatggctgtcaggcagcacatcaatctgagtgtgcggaaagtgtaatgtggtttttcaaagggtaaaggaaagggtcaatgctcgacatgtgaccagcacacttggggtagctgcatacttcagtgtaaaaatccactgtaagcaaaggcctaacccaacagcctacagctgcataattctgaacctttgcaattactaaaagaaaacttcatagatttgaaaataggactgtctaatttttcatgaggcaaatttcaaaaagagaaactgtaattggcacaaaatggctaagaaaaaaaacaaacaaaagagaaacacatgttttggatctggggatctagctcagaggtagagcgcttacctagcacacacgaggctctgggttcaatccctagcacagccaaacaaaacaatccatcctatccaagagaaagctatttcataatcataaataaaaatatttgtatcattttcagttagatagcaataaatcctacatcaaaaactttccctgataaaaacgtgtgcagaacacacatcagtagagcaatataccatgcttcaccttactaagctgttggctaaaatttcttcttgattttacctatgtacaagttaacattcaaaggggcttcaaaaagggtagggaggggaaaacagtatcaggatctatgacacccaggacaaacacacatagttaatttccacccaaatcataccaaagcattgacccagcaagaccagatgtgcatctcacttaatgtttatcaaaactaaggactttcgtatttacaaacagatcctttaagtattgtgacttctgtaattcttaacaattttaacatggtagcaagggtcaaccacagtatatttaaatatattttcattagtaaattactttcacatcctagaccatcatcctagcagcctattttctactaaaataaaaaaaaatttatttttaaaaattaaaaagtgaagcaggcacctattttccaggacttaatcatatacagaacactaagctcttgacacagaagaaacactggaacgaacccaccaccagcactgaagggcgggttctcctgtggtacattcatggagaacgttaagtagaaggaaatatatttgtatcctctgtctctcctttctcaactggaaaagaaaggaaataagtcagccaggacacagctgaaatccttcgcagggcatcgagaaagcacgtgctcacaaaaaacctcagctcgtttagaagaacagggctgactttagagtagaggaatgcaccagagttaaataatgatcccactaaaaaaggctttaaaaccaacagatcaccatgttagacttgcaggaaaataaccaaaaccagagaaaataacaccaggaagcatccatgtgcctgacacatacacgaaaagacagactgatctttccatagcaagacatacaaacgatatttcacaaaaggttggtgtgaaatgaagaaaagcccaaacaagccaagccagctccaatgcagagagaagacggaactctacaggatcaagttctgtggcaagagctaacgagttggtccaaaagagccaaggaaaattccataatttcagtcagatattgcacatttgaaaaacaaggagggacatttagaaaactacgttgtttctttcattgctgactgcctctttggctagcatctcgtggttctttagtcctaggacgcttctgccctttctgcttacaaaccatgcagtgtctgctgccttccggtgaacacactgctgccaaagtggaccttacactgtgatcacacaaacaatgttacaaagcatggtggcaaaatgatttttaaagggactatttttttctttctgctttcaaactgtctttagcagtttctaaagacacagtcacagttgcccgaagcacgtcctcttcactcatagcattgccttggttgctccggagtcctcctgaacttgtggtgggtctttcacatgggtatgaaaggtatccaggtcggtctgcttcctgttgctgatgctgttgcttttcaaagtaggcttctctcctcttccgcagctcttctgaagaaagatctgtgcttgatgtctgcggactatcttcacacatacctctggaactaccttgcatactgagctgaatggccctgcggagatcggcttcttcgtcctccatgtcgatttcctggcgactcatggccagagccctctgtaaatcgtcctcatcatcatcaaacattcccggcccgtcagccgcctctaagactcgctccagatctgctttgagggcgctctgctctttcagatgtgcgagttcttctccaataagttttggtcgatgcatctgttggaccttgatcatctgtaaaagttggtcagcttcacaatctggcagatcacccttaacaacaaatatagaataaccttcttgctgtaactgagccaagaacagtgcgaggtatgtatctgatattagctctggaccagtcaacaaagaattcaagttaaaccactgttttcctaattttctaactgtaaaccagtgttctttataattgcatataaaggatctttcatttataggatcgattctgagcctctggtactctggactgttgaataggattagttctaaaccccaaactttcaaggcattgcttataacttgaatagagaaaaagccgctgtcgtccatatttccagaaggctgctgtaaaaatgtgcggtagtcttcgctggtgacccctccttccgccatccgcagcctctcctcttcatccagctggtgtgcaattgaggacagctccacggggctaaaatactctccttgtaagaggttattcaagcaatgctgagcgcaaagggagccttcttgtttctcgtggaagatggactccatgtttatttgtctggagccaacggccccggcgcggagcagccccctccagcagctccgccccc

SEQ ID NO: 9 - protein, 16 aa, Unknown
  source: /note="Description of Unknown: RFGF peptide"
AAVALLPAVLLALLAP

SEQ ID NO: 10 - protein, 11 aa, Unknown
  source: /note="Description of Unknown: RFGF analogue peptide"
AALLPVLLAAP

SEQ ID NO: 11 - protein, 13 aa, Human immunodeficiency virus
GRKKRRQRRRPPQ

SEQ ID NO: 12 - protein, 16 aa, Drosophila sp.
RQIKIWFQNRRMKWKK

SEQ ID NO: 13 - RNA, 21 nt, Artificial Sequence
  source: /note="Description of Artificial Sequence: Synthetic oligonucleotide"
uuggcuccagacaaauaaaca

SEQ ID NO: 14 - RNA, 21 nt, Artificial Sequence
  source: /note="Description of Artificial Sequence: Synthetic oligonucleotide"
ggcuccagacaaauaaacauu

SEQ ID NO: 15 - RNA, 21 nt, Artificial Sequence
  source: /note="Description of Artificial Sequence: Synthetic oligonucleotide"
gcuccagacaaauaaacaugu

SEQ ID NO: 16 - RNA, 21 nt, Artificial Sequence
  source: /note="Description of Artificial Sequence: Synthetic oligonucleotide"
cuccagacaaauaaacaugga

SEQ ID NO: 17 - RNA, 21 nt, Artificial Sequence
  source: /note="Description of Artificial Sequence: Synthetic oligonucleotide"
ccagacaaauaaacauggagu

SEQ ID NO: 18 - RNA, 21 nt, Artificial Sequence
  source: /note="Description of Artificial Sequence: Synthetic oligonucleotide"
cagacaaauaaacauggaguu

SEQ ID NO: 19 - RNA, 21 nt, Artificial Sequence
  source: /note="Description of Artificial Sequence: Synthetic oligonucleotide"
agacaaauaaacauggagucu

SEQ ID NO: 20 - RNA, 21 nt, Artificial Sequence
  source: /note="Description of Artificial Sequence: Synthetic oligonucleotide"
gaguccaucuuccacgagaaa

SEQ ID NO: 21 - RNA, 21 nt, Artificial Sequence
  source: /note="Description of Artificial Sequence: Synthetic oligonucleotide"
uccaucuuccacgagaaacaa

SEQ ID NO: 22 - RNA, 21 nt, Artificial Sequence
  source: /note="Description of Artificial Sequence: Synthetic oligonucleotide"
caucuuccacgagaaacaaga

SEQ ID NO: 23 - RNA, 21 nt, Artificial Sequence
  source: /note="Description of Artificial Sequence: Synthetic oligonucleotide"
aucuuccacgagaaacaagaa

SEQ ID NO: 24 - RNA, 21 nt, Artificial Sequence
  source: /note="Description of Artificial Sequence: Synthetic oligonucleotide"
cuuccacgagaaacaagaagu

SEQ ID NO: 25 - RNA, 21 nt, Artificial Sequence
  source: /note="Description of Artificial Sequence: Synthetic oligonucleotide"
uuccacgagaaacaagaaggu

SEQ ID NO: 26 - RNA, 21 nt, Artificial Sequence
  source: /note="Description of Artificial Sequence: Synthetic oligonucleotide"
ccacgagaaacaagaaggcuu

SEQ ID NO: 27 - RNA, 21 nt, Artificial Sequence
  source: /note="Description of Artificial Sequence: Synthetic oligonucleotide"
uacagcagccuucuggaaaua

SEQ ID NO: 28 - RNA, 21 nt, Artificial Sequence
  source: /note="Description of Artificial Sequence: Synthetic oligonucleotide"
cagcagccuucuggaaauauu

SEQ ID NO: 29 - RNA, 21 nt, Artificial Sequence
  source: /note="Description of Artificial Sequence: Synthetic oligonucleotide"
agcagccuucuggaaauaugu

SEQ ID NO: 30 - RNA, 21 nt, Artificial Sequence
  source: /note="Description of Artificial Sequence: Synthetic oligonucleotide"
uucagugguuuaacuugaauu

SEQ ID NO: 31 - RNA, 21 nt, Artificial Sequence
  source: /note="Description of Artificial Sequence: Synthetic oligonucleotide"
ucagugguuuaacuugaauuu

SEQ ID NO: 32 - RNA, 21 nt, Artificial Sequence
  source: /note="Description of Artificial Sequence: Synthetic oligonucleotide"
cagugguuuaacuugaauucu

SEQ ID NO: 33 - RNA, 21 nt, Artificial Sequence
  source: /note="Description of Artificial Sequence: Synthetic oligonucleotide"
agugguuuaacuugaauucuu

SEQ ID NO: 34 - RNA, 21 nt, Artificial Sequence
  source: /note="Description of Artificial Sequence: Synthetic oligonucleotide"
aggaagguuauucuauauuug

SEQ ID NO: 35 - RNA, 21 nt, Artificial Sequence
  source: /note="Description of Artificial Sequence: Synthetic oligonucleotide"
ggaagguuauucuauauuugu

SEQ ID NO: 36 - RNA, 21 nt, Artificial Sequence
  source: /note="Description of Artificial Sequence: Synthetic oligonucleotide"
gaagguuauucuauauuuguu

SEQ ID NO: 37 - RNA, 21 nt, Artificial Sequence
  source: /note="Description of Artificial Sequence: Synthetic oligonucleotide"
aucgaccaaaacuuauuggau

SEQ ID NO: 38 - RNA, 21 nt, Artificial Sequence
  source: /note="Description of Artificial Sequence: Synthetic oligonucleotide"
ucgaccaaaacuuauuggaga

SEQ ID NO: 39 - RNA, 21 nt, Artificial Sequence
  source: /note="Description of Artificial Sequence: Synthetic oligonucleotide"
cgaccaaaacuuauuggagaa

SEQ ID NO: 40 - RNA, 21 nt, Artificial Sequence
  source: /note="Description of Artificial Sequence: Synthetic oligonucleotide"
acgagaagccuacuuugaaaa

SEQ ID NO: 41 - RNA, 21 nt, Artificial Sequence
  source: /note="Description of Artificial Sequence: Synthetic oligonucleotide"
cgagaagccuacuuugaaaaa

SEQ ID NO: 42 - RNA, 21 nt, Artificial Sequence
  source: /note="Description of Artificial Sequence: Synthetic oligonucleotide"
cuugggagugaucuaggugau

SEQ ID NO: 43 - RNA, 21 nt, Artificial Sequence
  source: /note="Description of Artificial Sequence: Synthetic oligonucleotide"
uugggagugaucuaggugauu

SEQ ID NO: 44 - RNA, 21 nt, Artificial Sequence
  source: /note="Description of Artificial Sequence: Synthetic oligonucleotide"
ggagugaucuaggugaugcua

SEQ ID NO: 45 - RNA, 21 nt, Artificial Sequence
  source: /note="Description of Artificial Sequence: Synthetic oligonucleotide"
gagugaucuaggugaugcuau

SEQ ID NO: 46 - RNA, 21 nt, Artificial Sequence
  source: /note="Description of Artificial Sequence: Synthetic oligonucleotide"
gaccaugucuuuagaaacugu

SEQ ID NO: 47 - RNA, 21 nt, Artificial Sequence
  source: /note="Description of Artificial Sequence: Synthetic oligonucleotide"
accaugucuuuagaaacuguu

SEQ ID NO: 48 - RNA, 21 nt, Artificial Sequence
  source: /note="Description of Artificial Sequence: Synthetic oligonucleotide"
ccaugucuuuagaaacuguca

SEQ ID NO: 49 - RNA, 21 nt, Artificial Sequence
  source: /note="Description of Artificial Sequence: Synthetic oligonucleotide"
caugucuuuagaaacugucau

SEQ ID NO: 50 - RNA, 21 nt, Artificial Sequence
  source: /note="Description of Artificial Sequence: Synthetic oligonucleotide"
ugucuuuagaaacugucagaa

SEQ ID NO: 51 - RNA, 21 nt, Artificial Sequence
  source: /note="Description of Artificial Sequence: Synthetic oligonucleotide"
gucuuuagaaacugucagaaa

SEQ ID NO: 52 - RNA, 21 nt, Artificial Sequence
  source: /note="Description of Artificial Sequence: Synthetic oligonucleotide"
cagaaaugauuugaaaacaga

SEQ ID NO: 53 - RNA, 21 nt, Artificial Sequence
  source: /note="Description of Artificial Sequence: Synthetic oligonucleotide"
aaugauuugaaaacagaagga

SEQ ID NO: 54 - RNA, 21 nt, Artificial Sequence
  source: /note="Description of Artificial Sequence: Synthetic oligonucleotide"
uuuuagcgguuugcaaacaaa

SEQ ID NO: 55 - RNA, 21 nt, Artificial Sequence
  source: /note="Description of Artificial Sequence: Synthetic oligonucleotide"
uuuagcgguuugcaaacaaaa

SEQ ID NO: 56 - RNA, 21 nt, Artificial Sequence
  source: /note="Description of Artificial Sequence: Synthetic oligonucleotide"
uuagcgguuugcaaacaaaau

SEQ ID NO: 57 - RNA, 21 nt, Artificial Sequence
  source: /note="Description of Artificial Sequence: Synthetic oligonucleotide"
uagcgguuugcaaacaaaauu

SEQ ID NO: 58 - RNA, 21 nt, Artificial Sequence
  source: /note="Description of Artificial Sequence: Synthetic oligonucleotide"
agcgguuugcaaacaaaauga

SEQ ID NO: 59 - RNA, 21 nt, Artificial Sequence
  source: /note="Description of Artificial Sequence: Synthetic oligonucleotide"
gcgguuugcaaacaaaaugau

SEQ ID NO: 60 - RNA, 21 nt, Artificial Sequence
  source: /note="Description of Artificial Sequence: Synthetic oligonucleotide"
guuugcaaacaaaaugauggu

SEQ ID NO: 61 - RNA, 21 nt, Artificial Sequence
  source: /note="Description of Artificial Sequence: Synthetic oligonucleotide"
uuugcaaacaaaaugauggga

SEQ ID NO: 62 - RNA, 21 nt, Artificial Sequence
  source: /note="Description of Artificial Sequence: Synthetic oligonucleotide"
gcauucagcaauuaaagacau

SEQ ID NO: 63 - RNA, 21 nt, Artificial Sequence
  source: /note="Description of Artificial Sequence: Synthetic oligonucleotide"
cauucagcaauuaaagacauu

SEQ ID NO: 64 - RNA, 21 nt, Artificial Sequence
  source: /note="Description of Artificial Sequence: Synthetic oligonucleotide"
uuugcagacuagcuaauuagu

SEQ ID NO: 65 - RNA, 21 nt, Artificial Sequence
  source: /note="Description of Artificial Sequence: Synthetic oligonucleotide"
uugcagacuagcuaauuagcu

SEQ ID NO: 66 - RNA, 21 nt, Artificial Sequence
  source: /note="Description of Artificial Sequence: Synthetic oligonucleotide"
ugcagacuagcuaauuagcuu

SEQ ID NO: 67 - RNA, 21 nt, Artificial Sequence
  source: /note="Description of Artificial Sequence: Synthetic oligonucleotide"
gcagacuagcuaauuagcucu

SEQ ID NO: 68 - RNA, 21 nt, Artificial Sequence
  source: /note="Description of Artificial Sequence: Synthetic oligonucleotide"
cagacuagcuaauuagcucuu

SEQ ID NO: 69 - RNA, 21 nt, Artificial Sequence
  source: /note="Description of Artificial Sequence: Synthetic oligonucleotide"
gauguugauaauaguaauggu

SEQ ID NO: 70 - RNA, 21 nt, Artificial Sequence
  source: /note="Description of Artificial Sequence: Synthetic oligonucleotide"
auguugauaauaguaaugguu

SEQ ID NO: 71 - RNA, 21 nt, Artificial Sequence
  source: /note="Description of Artificial Sequence: Synthetic oligonucleotide"
uguugauaauaguaaugguuu

SEQ ID NO: 72 - RNA, 21 nt, Artificial Sequence
  source: /note="Description of Artificial Sequence: Synthetic oligonucleotide"
guugauaauaguaaugguucu

SEQ ID NO: 73 - RNA, 21 nt, Artificial Sequence
  source: /note="Description of Artificial Sequence: Synthetic oligonucleotide"
uugauaauaguaaugguucua

SEQ ID NO: 74 - RNA, 21 nt, Artificial Sequence
  source: /note="Description of Artificial Sequence: Synthetic oligonucleotide"
ugauaauaguaaugguucuau

SEQ ID NO: 75 - RNA, 21 nt, Artificial Sequence
  source: /note="Description of Artificial Sequence: Synthetic oligonucleotide"
uuucugcuaccugguuuucau

SEQ ID NO: 76 - RNA, 21 nt, Artificial Sequence
  source: /note="Description of Artificial Sequence: Synthetic oligonucleotide"
uucugcuaccugguuuucauu

SEQ ID NO: 77 - RNA, 21 nt, Artificial Sequence
  source: /note="Description of Artificial Sequence: Synthetic oligonucleotide"
ucugcuaccugguuuucauua

SEQ ID NO: 78 - RNA, 21 nt, Artificial Sequence
  source: /note="Description of Artificial Sequence: Synthetic oligonucleotide"
gcuaccugguuuucauuauuu

SEQ ID NO: 79 - RNA, 21 nt, Artificial Sequence
  source: /note="Description of Artificial Sequence: Synthetic oligonucleotide"
accugguuuucauuauuuucu

SEQ ID NO: 80 - RNA, 21 nt, Artificial Sequence
  source: /note="Description of Artificial Sequence: Synthetic oligonucleotide"
ccugguuuucauuauuuuccu

SEQ ID NO: 81 - RNA, 21 nt, Artificial Sequence
  source: /note="Description of Artificial Sequence: Synthetic oligonucleotide"
cugguuuucauuauuuuccca

SEQ ID NO: 82 - RNA, 21 nt, Artificial Sequence
  source: /note="Description of Artificial Sequence: Synthetic oligonucleotide"
ugguuuucauuauuuucccau

SEQ ID NO: 83 - RNA, 21 nt, Artificial Sequence
  source: /note="Description of Artificial Sequence: Synthetic oligonucleotide"
gguuuucauuauuuucccaca

SEQ ID NO: 84 - RNA, 21 nt, Artificial Sequence
  source: /note="Description of Artificial Sequence: Synthetic oligonucleotide"
uuuucauuauuuucccacaau

SEQ ID NO: 85 - RNA, 21 nt, Artificial Sequence
  source: /note="Description of Artificial Sequence: Synthetic oligonucleotide"
uuucauuauuuucccacaauu

SEQ ID NO: 86 - RNA, 21 nt, Artificial Sequence
  source: /note="Description of Artificial Sequence: Synthetic oligonucleotide"
ucauuauuuucccacaauucu

SEQ ID NO: 87 - RNA, 21 nt, Artificial Sequence
  source: /note="Description of Artificial Sequence: Synthetic oligonucleotide"
auuauuuucccacaauucuuu

SEQ ID NO: 88 - RNA, 21 nt, Artificial Sequence
  source: /note="Description of Artificial Sequence: Synthetic oligonucleotide"
uuauuuucccacaauucuuuu

SEQ ID NO: 89 - RNA, 21 nt, Artificial Sequence
  source: /note="Description of Artificial Sequence: Synthetic oligonucleotide"
uauuuucccacaauucuuuug

SEQ ID NO: 90 - RNA, 21 nt, Artificial Sequence
  source: /note="Description of Artificial Sequence: Synthetic oligonucleotide"
auuuucccacaauucuuuuga

SEQ ID NO: 91 - RNA, 21 nt, Artificial Sequence
  source: /note="Description of Artificial Sequence: Synthetic oligonucleotide"
uuuucccacaauucuuuugaa

SEQ ID NO: 92 - RNA, 21 nt, Artificial Sequence
  source: /note="Description of Artificial Sequence: Synthetic oligonucleotide"
uuucccacaauucuuuugaaa

SEQ ID NO: 93 - RNA, 21 nt, Artificial Sequence
  source: /note="Description of Artificial Sequence: Synthetic oligonucleotide"
uucccacaauucuuuugaaau

SEQ ID NO: 94 - RNA, 21 nt, Artificial Sequence
  source: /note="Description of Artificial Sequence: Synthetic oligonucleotide"
ucccacaauucuuuugaaaga

SEQ ID NO: 95 - RNA, 21 nt, Artificial Sequence
  source: /note="Description of Artificial Sequence: Synthetic oligonucleotide"
ccacaauucuuuugaaagauu

SEQ ID NO: 96 - RNA, 21 nt, Artificial Sequence
  source: /note="Description of Artificial Sequence: Synthetic oligonucleotide"
cuuuugaaagaugguaaucuu

SEQ ID NO: 97 - RNA, 21 nt, Artificial Sequence
  source: /note="Description of Artificial Sequence: Synthetic oligonucleotide"
uuuugaaagaugguaaucuuu

SEQ ID NO: 98 - RNA, 21 nt, Artificial Sequence
  source: /note="Description of Artificial Sequence: Synthetic oligonucleotide"
uuugaaagaugguaaucuuuu

SEQ ID NO: 99 - RNA, 21 nt, Artificial Sequence
  source: /note="Description of Artificial Sequence: Synthetic oligonucleotide"
uugaaagaugguaaucuuuuc

SEQ ID NO: 100 - RNA, 21 nt, Artificial Sequence
  source: /note="Description of Artificial Sequence: Synthetic oligonucleotide"
ugaaagaugguaaucuuuucu

SEQ ID NO: 101 - RNA, 21 nt, Artificial Sequence
  source: /note="Description of Artificial Sequence: Synthetic oligonucleotide"
gaaagaugguaaucuuuucuu

SEQ ID NO: 102 - RNA, 21 nt, Artificial Sequence
  source: /note="Description of Artificial Sequence: Synthetic oligonucleotide"
aaagaugguaaucuuuucuga

SEQ ID NO: 103 - RNA, 21 nt, Artificial Sequence
  source: /note="Description of Artificial Sequence: Synthetic oligonucleotide"
gacuggugcguuccuaaacuu

SEQ ID NO: 104 - RNA, 21 nt, Artificial Sequence
  source: /note="Description of Artificial Sequence: Synthetic oligonucleotide"
cuggugcguuccuaaacucuu

SEQ ID NO: 105 - RNA, 21 nt, Artificial Sequence
  source: /note="Description of Artificial Sequence: Synthetic oligonucleotide"
uggugcguuccuaaacucuga

SEQ ID NO: 106 - RNA, 21 nt, Artificial Sequence
  source: /note="Description of Artificial Sequence: Synthetic oligonucleotide"
ggugcguuccuaaacucugaa

SEQ ID NO: 107 - RNA, 21 nt, Artificial Sequence
  source: /note="Description of Artificial Sequence: Synthetic oligonucleotide"
gugcguuccuaaacucugaaa

SEQ ID NO: 108 - RNA, 21 nt, Artificial Sequence
  source: /note="Description of Artificial Sequence: Synthetic oligonucleotide"
ugcguuccuaaacucugaaau

SEQ ID NO: 109 - RNA, 21 nt, Artificial Sequence
  source: /note="Description of Artificial Sequence: Synthetic oligonucleotide"
uuuaaaaugugugagcauguu

SEQ ID NO: 110 - RNA, 21 nt, Artificial Sequence
  source: /note="Description of Artificial Sequence: Synthetic oligonucleotide"
uuaaaaugugugagcaugugu

SEQ ID NO: 111 - RNA, 21 nt, Artificial Sequence
  source: /note="Description of Artificial Sequence: Synthetic oligonucleotide"
ugugagcaugugcuuucccau

SEQ ID NO: 112 - RNA, 21 nt, Artificial Sequence
  source: /note="Description of Artificial Sequence: Synthetic oligonucleotide"
gugagcaugugcuuucccaga

SEQ ID NO: 113 - RNA, 21 nt, Artificial Sequence
  source: /note="Description of Artificial Sequence: Synthetic oligonucleotide"
gagcaugugcuuucccagauu

SEQ ID NO: 114 - RNA, 21 nt, Artificial Sequence
  source: /note="Description of Artificial Sequence: Synthetic oligonucleotide"
agcaugugcuuucccagaugu

SEQ ID NO: 115 - RNA, 21 nt, Artificial Sequence
  source: /note="Description of Artificial Sequence: Synthetic oligonucleotide"
caugugcuuucccagaugcuu

SEQ ID NO: 116 - RNA, 21 nt, Artificial Sequence
  source: /note="Description of Artificial Sequence: Synthetic oligonucleotide"
augugcuuucccagaugcuuu

SEQ ID NO: 117 - RNA, 21 nt, Artificial Sequence
  source: /note="Description of Artificial Sequence: Synthetic oligonucleotide"
ugugcuuucccagaugcuuua

SEQ ID NO: 118 - RNA, 21 nt, Artificial Sequence
  source: /note="Description of Artificial Sequence: Synthetic oligonucleotide"
gcuuucccagaugcuuuauga

SEQ ID NO: 119 - RNA, 21 nt, Artificial Sequence
  source: /note="Description of Artificial Sequence: Synthetic oligonucleotide"
cuuucccagaugcuuuaugaa

SEQ ID NO: 120 - RNA, 21 nt, Artificial Sequence
  source: /note="Description of Artificial Sequence: Synthetic oligonucleotide"
uuucccagaugcuuuaugaau

SEQ ID NO: 121 - RNA, 21 nt, Artificial Sequence
  source: /note="Description of Artificial Sequence: Synthetic oligonucleotide"
uucccagaugcuuuaugaauu

SEQ ID NO: 122 - RNA, 21 nt, Artificial Sequence
  source: /note="Description of Artificial Sequence: Synthetic oligonucleotide"
uuucacuuauaucaaaaccuu

SEQ ID NO: 123 - RNA, 21 nt, Artificial Sequence
  source: /note="Description of Artificial Sequence: Synthetic oligonucleotide"
cacuuauaucaaaaccuuaca

SEQ ID NO: 124 - RNA, 21 nt, Artificial Sequence
  source: /note="Description of Artificial Sequence: Synthetic oligonucleotide"
cuuauaucaaaaccuuacagu

SEQ ID NO: 125 - RNA, 21 nt, Artificial Sequence
  source: /note="Description of Artificial Sequence: Synthetic oligonucleotide"
uuauaucaaaaccuuacagcu

SEQ ID NO: 126 - RNA, 21 nt, Artificial Sequence
  source: /note="Description of Artificial Sequence: Synthetic oligonucleotide"
auaucaaaaccuuacagcuuu

SEQ ID NO: 127 - RNA, 21 nt, Artificial Sequence
  source: /note="Description of Artificial Sequence: Synthetic oligonucleotide"
aucaaaaccuuacagcuuugu

SEQ ID NO: 128 - RNA, 21 nt, Artificial Sequence
  source: /note="Description of Artificial Sequence: Synthetic oligonucleotide"
ucaaaaccuuacagcuuuguu

SEQ ID NO: 129 - RNA, 21 nt, Artificial Sequence
  source: /note="Description of Artificial Sequence: Synthetic oligonucleotide"
caaaaccuuacagcuuuguuu

SEQ ID NO: 130 - RNA, 21 nt, Artificial Sequence
  source: /note="Description of Artificial Sequence: Synthetic oligonucleotide"
aaaaccuuacagcuuuguugu

SEQ ID NO: 131 - RNA, 21 nt, Artificial Sequence
  source: /note="Description of Artificial Sequence: Synthetic oligonucleotide"
aaaccuuacagcuuuguugca

SEQ ID NO: 132 - RNA, 21 nt, Artificial Sequence
  source: /note="Description of Artificial Sequence: Synthetic oligonucleotide"
aaccuuacagcuuuguugcaa

SEQ ID NO: 133 - RNA, 21 nt, Artificial Sequence
  source: /note="Description of Artificial Sequence: Synthetic oligonucleotide"
accuuacagcuuuguugcaau

SEQ ID NO: 134 - RNA, 21 nt, Artificial Sequence
  source: /note="Description of Artificial Sequence: Synthetic oligonucleotide"
ccuuacagcuuuguugcaacu

SEQ ID NO: 135 - RNA, 21 nt, Artificial Sequence
  source: /note="Description of Artificial Sequence: Synthetic oligonucleotide"
cuuacagcuuuguugcaaccu

SEQ ID NO: 136 - RNA, 21 nt, Artificial Sequence
  source: /note="Description of Artificial Sequence: Synthetic oligonucleotide"
cuucuuccugcgccuuauuuu

SEQ ID NO: 137 - RNA, 21 nt, Artificial Sequence
  source: /note="Description of Artificial Sequence: Synthetic oligonucleotide"
uucuuccugcgccuuauuuuu

SEQ ID NO: 138 - RNA, 21 nt, Artificial Sequence
  source: /note="Description of Artificial Sequence: Synthetic oligonucleotide"
ccuuucuucuccaauugagaa

SEQ ID NO: 139 - RNA, 21 nt, Artificial Sequence
  source: /note="Description of Artificial Sequence: Synthetic oligonucleotide"
cuuucuucuccaauugagaaa

SEQ ID NO: 140 - RNA, 21 nt, Artificial Sequence
  source: /note="Description of Artificial Sequence: Synthetic oligonucleotide"
uuucuucuccaauugagaaaa

SEQ ID NO: 141 - RNA, 21 nt, Artificial Sequence
  source: /note="Description of Artificial Sequence: Synthetic oligonucleotide"
uucuucuccaauugagaaaau

SEQ ID NO: 142 - RNA, 21 nt, Artificial Sequence
  source: /note="Description of Artificial Sequence: Synthetic oligonucleotide"
cagugguuuaacuugaauucu

SEQ ID NO: 143 - RNA, 21 nt, Artificial Sequence
  source: /note="Description of Artificial Sequence: Synthetic oligonucleotide"
agugguuuaacuugaauucuu

SEQ ID NO: 144 - RNA, 21 nt, Artificial Sequence
  source: /note="Description of Artificial Sequence: Synthetic oligonucleotide"
agcagugguuuaacuugaauu

SEQ ID NO: 145 - RNA, 21 nt, Artificial Sequence
  source: /note="Description of Artificial Sequence: Synthetic oligonucleotide"
gcagugguuuaacuugaauuu

SEQ ID NO: 146 - RNA, 21 nt, Artificial Sequence
  source: /note="Description of Artificial Sequence: Synthetic oligonucleotide"
aagaagguuauucuauauuug

SEQ ID NO: 147 - RNA, 21 nt, Artificial Sequence
  source: /note="Description of Artificial Sequence: Synthetic oligonucleotide"
agaagguuauucuauauuugu

SEQ ID NO: 148 - RNA, 21 nt, Artificial Sequence
  source: /note="Description of Artificial Sequence: Synthetic oligonucleotide"
cgaccaaaacuuauuggagau

SEQ ID NO: 149 - RNA, 21 nt, Artificial Sequence
  source: /note="Description of Artificial Sequence: Synthetic oligonucleotide"
cgagaagccuacuuugaaaau

SEQ ID NO: 150 - RNA, 21 nt, Artificial Sequence
  source: /note="Description of Artificial Sequence: Synthetic oligonucleotide"
gaguccaucuuccacgagaaa

SEQ ID NO: 151 - RNA, 21 nt, Artificial Sequence
  source: /note="Description of Artificial Sequence: Synthetic oligonucleotide"
ggcuccagacaaauaaacaua

SEQ ID NO: 152 - RNA, 21 nt, Artificial Sequence
  source: /note="Description of Artificial Sequence: Synthetic oligonucleotide"
aauaaacauggaguccaucua

SEQ ID NO: 153 - RNA, 21 nt, Artificial Sequence
  source: /note="Description of Artificial Sequence: Synthetic oligonucleotide"
aguccaucuuccacgagaaaa

SEQ ID NO: 154 - RNA, 21 nt, Artificial Sequence
  source: /note="Description of Artificial Sequence: Synthetic oligonucleotide"
ugcaaggagaguauuuuagca

SEQ ID NO: 155 - RNA, 21 nt, Artificial Sequence
  source: /note="Description of Artificial Sequence: Synthetic oligonucleotide"
gcaaggagaguauuuuagcca

SEQ ID NO: 156 - RNA, 21 nt, Artificial Sequence
  source: /note="Description of Artificial Sequence: Synthetic oligonucleotide"
gaagacuaccgcacauuuuua

SEQ ID NO: 157 - RNA, 21 nt, Artificial Sequence
  source: /note="Description of Artificial Sequence: Synthetic oligonucleotide"
agacuaccgcacauuuuuaca

SEQ ID NO: 158 - RNA, 21 nt, Artificial Sequence
  source: /note="Description of Artificial Sequence: Synthetic oligonucleotide"
cuaccgcacauuuuuacagca

SEQ ID NO: 159 - RNA, 21 nt, Artificial Sequence
  source: /note="Description of Artificial Sequence: Synthetic oligonucleotide"
gugaagacuaccgcacauuua

SEQ ID NO: 160 - RNA, 21 nt, Artificial Sequence
  source: /note="Description of Artificial Sequence: Synthetic oligonucleotide"
ugaagacuaccgcacauuuua

SEQ ID NO: 161 - RNA, 21 nt, Artificial Sequence
  source: /note="Description of Artificial Sequence: Synthetic oligonucleotide"
aagacuaccgcacauuuuuaa

SEQ ID NO: 162 - RNA, 21 nt, Artificial Sequence
  source: /note="Description of Artificial Sequence: Synthetic oligonucleotide"
acuaccgcacauuuuuacaga

SEQ ID NO: 163 - RNA, 21 nt, Artificial Sequence
  source: /note="Description of Artificial Sequence: Synthetic oligonucleotide"
uaccgcacauuuuuacagcaa

SEQ ID NO: 164 - RNA, 21 nt, Artificial Sequence
  source: /note="Description of Artificial Sequence: Synthetic oligonucleotide"
ccgcacauuuuuacagcagca

SEQ ID NO: 165 - RNA, 21 nt, Artificial Sequence
  source: /note="Description of Artificial Sequence: Synthetic oligonucleotide"
cagcagccuucuggaaauaua

SEQ ID NO: 166 - RNA, 21 nt, Artificial Sequence
  source: /note="Description of Artificial Sequence: Synthetic oligonucleotide"
cagcggcuuuuucucuauuca

SEQ ID NO: 167 - RNA, 21 nt, Artificial Sequence
  source: /note="Description of Artificial Sequence: Synthetic oligonucleotide"
ucucuauucaaguuauaagca

SEQ ID NO: 168 - RNA, 21 nt, Artificial Sequence
  source: /note="Description of Artificial Sequence: Synthetic oligonucleotide"
cucuauucaaguuauaagcaa

SEQ ID NO: 169 - RNA, 21 nt, Artificial Sequence
  source: /note="Description of Artificial Sequence: Synthetic oligonucleotide"
ugacagcggcuuuuucucuaa

SEQ ID NO: 170 - RNA, 21 nt, Artificial Sequence
  source: /note="Description of Artificial Sequence: Synthetic oligonucleotide"
gcggcuuuuucucuauucaaa

SEQ ID NO: 171 - RNA, 21 nt, Artificial Sequence
  source: /note="Description of Artificial Sequence: Synthetic oligonucleotide"
uauucaaguuauaagcaauga

SEQ ID NO: 172 - RNA, 21 nt, Artificial Sequence
  source: /note="Description of Artificial Sequence: Synthetic oligonucleotide"
aagauccuuuauaugcaauua

SEQ ID NO: 173 - RNA, 21 nt, Artificial Sequence
  source: /note="Description of Artificial Sequence: Synthetic oligonucleotide"
aacacugguuuacaguuagaa

SEQ ID NO: 174 - RNA, 21 nt, Artificial Sequence
  source: /note="Description of Artificial Sequence: Synthetic oligonucleotide"
acacugguuuacaguuagaaa

SEQ ID NO: 175 - RNA, 21 nt, Artificial Sequence
  source: /note="Description of Artificial Sequence: Synthetic oligonucleotide"
aaagauccuuuauaugcaaua

SEQ ID NO: 176 - RNA, 21 nt, Artificial Sequence
  source: /note="Description of Artificial Sequence: Synthetic oligonucleotide"
caauuauaaagaacacuggua

SEQ ID NO: 177 - RNA, 21 nt, Artificial Sequence
  source: /note="Description of Artificial Sequence: Synthetic oligonucleotide"
aaagaacacugguuuacagua

SEQ ID NO: 178 - RNA, 21 nt, Artificial Sequence
  source: /note="Description of Artificial Sequence: Synthetic oligonucleotide"
agaacacugguuuacaguuaa

SEQ ID NO: 179 - RNA, 21 nt, Artificial Sequence
  source: /note="Description of Artificial Sequence: Synthetic oligonucleotide"
agcagugguuuaacuugaaua

SEQ ID NO: 180 - RNA, 21 nt, Artificial Sequence
  source: /note="Description of Artificial Sequence: Synthetic oligonucleotide"
uacagcaagaagguuauucua

SEQ ID NO: 181 - RNA, 21 nt, Artificial Sequence
  source: /note="Description of Artificial Sequence: Synthetic oligonucleotide"
aauuacagcaagaagguuaua

SEQ ID NO: 182 - RNA, 21 nt, Artificial Sequence
  source: /note="Description of Artificial Sequence: Synthetic oligonucleotide"
auuacagcaagaagguuauua

SEQ ID NO: 183 - RNA, 21 nt, Artificial Sequence
  source: /note="Description of Artificial Sequence: Synthetic oligonucleotide"
acagcaagaagguuauucuaa

SEQ ID NO: 184 - RNA, 21 nt, Artificial Sequence
  source: /note="Description of Artificial Sequence: Synthetic oligonucleotide"
agcaagaagguuauucuauaa

SEQ ID NO: 185 - RNA, 21 nt, Artificial Sequence
  source: /note="Description of Artificial Sequence: Synthetic oligonucleotide"
gcaagaagguuauucuauaua

SEQ ID NO: 186 - RNA, 21 nt, Artificial Sequence
  source: /note="Description of Artificial Sequence: Synthetic oligonucleotide"
caagaagguuauucuauauua

SEQ ID NO: 187 - RNA, 21 nt, Artificial Sequence
  source: /note="Description of Artificial Sequence: Synthetic oligonucleotide"
aagggugaucugccagauuga

SEQ ID NO: 188 - RNA, 21 nt, Artificial Sequence
  source: /note="Description of Artificial Sequence: Synthetic oligonucleotide"
uugugaagcugaccaacuuua

SEQ ID NO: 189 - RNA, 21 nt, Artificial Sequence
  source: /note="Description of Artificial Sequence: Synthetic oligonucleotide"
ugugaagcugaccaacuuuua

SEQ ID NO: 190 - RNA, 21 nt, Artificial Sequence
  source: /note="Description of Artificial Sequence: Synthetic oligonucleotide"
caacagaugcaucgaccaaaa

SEQ ID NO: 191 - RNA, 21 nt, Artificial Sequence
  source: /note="Description of Artificial Sequence: Synthetic oligonucleotide"
agaugcaucgaccaaaacuua

SEQ ID NO: 192 - RNA, 21 nt, Artificial Sequence
  source: /note="Description of Artificial Sequence: Synthetic oligonucleotide"
ucgaccaaaacuuauuggaga

SEQ ID NO: 193 - RNA, 21 nt, Artificial Sequence
  source: /note="Description of Artificial Sequence: Synthetic oligonucleotide"
cagaugaucaagguccaacaa

SEQ ID NO: 194 - RNA, 21 nt, Artificial Sequence
  source: /note="Description of Artificial Sequence: Synthetic oligonucleotide"
gaugaucaagguccaacagaa

SEQ ID NO: 195 - RNA, 21 nt, Artificial Sequence
  source: /note="Description of Artificial Sequence: Synthetic oligonucleotide"
augaucaagguccaacagaua

SEQ ID NO: 196 - RNA, 21 nt, Artificial Sequence
  source: /note="Description of Artificial Sequence: Synthetic oligonucleotide"
acagaugcaucgaccaaaaca

SEQ ID NO: 197 - RNA, 21 nt, Artificial Sequence
  source: /note="Description of Artificial Sequence: Synthetic oligonucleotide"
cagaugcaucgaccaaaacua

SEQ ID NO: 198 - RNA, 21 nt, Artificial Sequence
  source: /note="Description of Artificial Sequence: Synthetic oligonucleotide"
gaugcaucgaccaaaacuuaa

SEQ ID NO: 199 - RNA, 21 nt, Artificial Sequence
  source: /note="Description of Artificial Sequence: Synthetic oligonucleotide"
augcaucgaccaaaacuuaua

SEQ ID NO: 200 - RNA, 21 nt, Artificial Sequence
  source: /note="Description of Artificial Sequence: Synthetic oligonucleotide"
aucgaccaaaacuuauuggaa

SEQ ID NO: 201 - RNA, 21 nt, Artificial Sequence
  source: /note="Description of Artificial Sequence: Synthetic oligonucleotide"
guaugcaagguaguuccagaa

SEQ ID NO: 202 - RNA, 21 nt, Artificial Sequence
  source: /note="Description of Artificial Sequence: Synthetic oligonucleotide"
ucagcucaguaugcaagguaa

SEQ ID NO: 203 - RNA, 21 nt, Artificial Sequence
  source: /note="Description of Artificial Sequence: Synthetic oligonucleotide"
cagcucaguaugcaagguaga

SEQ ID NO: 204 - RNA, 21 nt, Artificial Sequence
  source: /note="Description of Artificial Sequence: Synthetic oligonucleotide"
gcucaguaugcaagguaguua

SEQ ID NO: 205 - RNA, 21 nt, Artificial Sequence
  source: /note="Description of Artificial Sequence: Synthetic oligonucleotide"
cuacuuugaaaagcaacagca

SEQ ID NO: 206 - RNA, 21 nt, Artificial Sequence
  source: /note="Description of Artificial Sequence: Synthetic oligonucleotide"
agugguuuguaagcagaaaga

SEQ ID NO: 207 - RNA, 21 nt, Artificial Sequence
  source: /note="Description of Artificial Sequence: Synthetic oligonucleotide"
aagaggcagucagcaaugaaa

SEQ ID NO: 208 - RNA, 21 nt, Artificial Sequence
  source: /note="Description of Artificial Sequence: Synthetic oligonucleotide"
aaaugugcaauaucugacuga

SEQ ID NO: 209 - RNA, 21 nt, Artificial Sequence
  source: /note="Description of Artificial Sequence: Synthetic oligonucleotide"
aaugugcaauaucugacugaa

SEQ ID NO: 210 - RNA, 21 nt, Artificial Sequence
  source: /note="Description of Artificial Sequence: Synthetic oligonucleotide"
auaucugacugaaauuaugga

SEQ ID NO: 211 - RNA, 21 nt, Artificial Sequence
  source: /note="Description of Artificial Sequence: Synthetic oligonucleotide"
uucaaaugugcaauaucugaa

SEQ ID NO: 212 - RNA, 21 nt, Artificial Sequence
  source: /note="Description of Artificial Sequence: Synthetic oligonucleotide"
ucaaaugugcaauaucugaca

SEQ ID NO: 213 - RNA, 21 nt, Artificial Sequence
  source: /note="Description of Artificial Sequence: Synthetic oligonucleotide"
aauaucugacugaaauuauga

SEQ ID NO: 214 - RNA, 21 nt, Artificial Sequence
  source: /note="Description of Artificial Sequence: Synthetic oligonucleotide"
agcucuugccacagaacuuga

SEQ ID NO: 215 - RNA, 21 nt, Artificial Sequence
  source: /note="Description of Artificial Sequence: Synthetic oligonucleotide"
gcucuugccacagaacuugaa

SEQ ID NO: 216 - RNA, 21 nt, Artificial Sequence
  source: /note="Description of Artificial Sequence: Synthetic oligonucleotide"
cuaguagaaaauaggcugcua

SEQ ID NO: 217 - RNA, 21 nt, Artificial Sequence
  source: /note="Description of Artificial Sequence: Synthetic oligonucleotide"
gaaaauaggcugcuaggauga

SEQ ID NO: 218 - RNA, 21 nt, Artificial Sequence
  source: /note="Description of Artificial Sequence: Synthetic oligonucleotide"
uaguagaaaauaggcugcuaa

SEQ ID NO: 219 - RNA, 21 nt, Artificial Sequence
  source: /note="Description of Artificial Sequence: Synthetic oligonucleotide"
agaaaauaggcugcuaggaua

SEQ ID NO: 220 - RNA, 21 nt, Artificial Sequence
  source: /note="Description of Artificial Sequence: Synthetic oligonucleotide"
guaugauuuggguggaaauua

SEQ ID NO: 221 - RNA, 21 nt, Artificial Sequence
  source: /note="Description of Artificial Sequence: Synthetic oligonucleotide"
gguaugauuuggguggaaaua

SEQ ID NO: 222 - RNA, 21 nt, Artificial Sequence
  source: /note="Description of Artificial Sequence: Synthetic oligonucleotide"
ugcacacguuuuuaucaggga

SEQ ID NO: 223 - RNA, 21 nt, Artificial Sequence
  source: /note="Description of Artificial Sequence: Synthetic oligonucleotide"
gcacacguuuuuaucagggaa

SEQ ID NO: 224 - RNA, 21 nt, Artificial Sequence
  source: /note="Description of Artificial Sequence: Synthetic oligonucleotide"
cacacguuuuuaucagggaaa

SEQ ID NO: 225 - RNA, 21 nt, Artificial Sequence
  source: /note="Description of Artificial Sequence: Synthetic oligonucleotide"
uuuuuaucagggaaaguuuua

SEQ ID NO: 226 - RNA, 21 nt, Artificial Sequence
  source: /note="Description of Artificial Sequence: Synthetic oligonucleotide"
uggauguaggauuuauugcua

SEQ ID NO: 227 - RNA, 21 nt, Artificial Sequence
  source: /note="Description of Artificial Sequence: Synthetic oligonucleotide"
aguaauugcaaagguucagaa

SEQ ID NO: 228 - RNA, 21 nt, Artificial Sequence
  source: /note="Description of Artificial Sequence: Synthetic oligonucleotide"
augaaaagaugccaaugcuua

SEQ ID NO: 229 - RNA, 21 nt, Artificial Sequence
  source: /note="Description of Artificial Sequence: Synthetic oligonucleotide"
guaugaaaagaugccaaugca

SEQ ID NO: 230 - RNA, 21 nt, Artificial Sequence
  source: /note="Description of Artificial Sequence: Synthetic oligonucleotide"
gccacaguauccaaaguguaa

SEQ ID NO: 231 - RNA, 21 nt, Artificial Sequence
  source: /note="Description of Artificial Sequence: Synthetic oligonucleotide"
uuucuugaugaagccaaagua

SEQ ID NO: 232 - RNA, 21 nt, Artificial Sequence
  source: /note="Description of Artificial Sequence: Synthetic oligonucleotide"
augaagccaaaguuaaugaga

SEQ ID NO: 233 - RNA, 21 nt, Artificial Sequence
  source: /note="Description of Artificial Sequence: Synthetic oligonucleotide"
auuuaguccuaacaaguguaa

SEQ ID NO: 234 - RNA, 21 nt, Artificial Sequence
  source: /note="Description of Artificial Sequence: Synthetic oligonucleotide"
guccuaacaaguguagagcua

SEQ ID NO: 235 - RNA, 21 nt, Artificial Sequence
  source: /note="Description of Artificial Sequence: Synthetic oligonucleotide"
aguccuaacaaguguagagca

SEQ ID NO: 236 - RNA, 21 nt, Artificial Sequence
  source: /note="Description of Artificial Sequence: Synthetic oligonucleotide"
gucauuuuaagaauuagcaca

SEQ ID NO: 237 - RNA, 21 nt, Artificial Sequence
  source: /note="Description of Artificial Sequence: Synthetic oligonucleotide"
aacacuggacuaauaggaaua

SEQ ID NO: 238 - RNA, 21 nt, Artificial Sequence
  source: /note="Description of Artificial Sequence: Synthetic oligonucleotide"
caacacuggacuaauaggaaa

SEQ ID NO: 239 - RNA, 21 nt, Artificial Sequence
  source: /note="Description of Artificial Sequence: Synthetic oligonucleotide"
acuggacuaauaggaauaaca

SEQ ID NO: 240 - RNA, 21 nt, Artificial Sequence
  source: /note="Description of Artificial Sequence: Synthetic oligonucleotide"
cuggacuaauaggaauaacua

SEQ ID NO: 241 - RNA, 21 nt, Artificial Sequence
  source: /note="Description of Artificial Sequence: Synthetic oligonucleotide"
uggacuaauaggaauaacuua

SEQ ID NO: 242 - RNA, 21 nt, Artificial Sequence
  source: /note="Description of Artificial Sequence: Synthetic oligonucleotide"
gacuaauaggaauaacuuuua

SEQ ID NO: 243 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguuuatuugucuggagccaacg

SEQ ID NO: 244 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauguutauuugucuggagccaa

SEQ ID NO: 245 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaugutuauuugucuggagcca

SEQ ID NO: 246 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaugtuuauuugucuggagcc

SEQ ID NO: 247 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuccatguuuauuugucuggag

SEQ ID NO: 248 - RNA, 23 nt, Artificial Sequence
  source: /note="Description of Artificial Sequence: Synthetic oligonucleotide"
aacuccauguuuauuugucugga

SEQ ID NO: 249 - RNA, 23 nt, Artificial Sequence
  source: /note="Description of Artificial Sequence: Synthetic oligonucleotide"
agacuccauguuuauuugucugg

SEQ ID NO: 250 - RNA, 23 nt, Artificial Sequence
  source: /note="Description of Artificial Sequence: Synthetic oligonucleotide"
uuucucguggaagauggacucca

SEQ ID NO: 251 - RNA, 23 nt, Artificial Sequence
  source: /note="Description of Artificial Sequence: Synthetic oligonucleotide"
uuguuucucguggaagauggacu

SEQ ID NO: 252 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuugutucucguggaagaugga

SEQ ID NO: 253 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucuugtuucucguggaagaugg

SEQ ID NO: 254 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucutguuucucguggaagau

SEQ ID NO: 255 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accuuctuguuucucguggaaga

SEQ ID NO: 256 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagccutcuuguuucucguggaa

SEQ ID NO: 257 - RNA, 23 nt, Artificial Sequence
  source: /note="Description of Artificial Sequence: Synthetic oligonucleotide"
uauuuccagaaggcugcuguaaa

SEQ ID NO: 258 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauauutccagaaggcugcugua

SEQ ID NO: 259 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauautuccagaaggcugcugu

SEQ ID NO: 260 - RNA, 23 nt, Artificial Sequence
  source: /note="Description of Artificial Sequence: Synthetic oligonucleotide"
aauucaaguuaaaccacugaaua

SEQ ID NO: 261 - RNA, 23 nt, Artificial Sequence
  source: /note="Description of Artificial Sequence: Synthetic oligonucleotide"
aaauucaaguuaaaccacugaau

SEQ ID NO: 262 - RNA, 23 nt, Artificial Sequence
  source: /note="Description of Artificial Sequence: Synthetic oligonucleotide"
agaauucaaguuaaaccacugaa

SEQ ID NO: 263 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaautcaaguuaaaccacuga

SEQ ID NO: 264 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaauatagaauaaccuuccugu

SEQ ID NO: 265 - RNA, 23 nt, Artificial Sequence
  source: /note="Description of Artificial Sequence: Synthetic oligonucleotide"
acaaauauagaauaaccuuccug

SEQ ID NO: 266 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaaatauagaauaaccuuccu

SEQ ID NO: 267 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auccaataaguuuuggucgaugc

SEQ ID NO: 268 - RNA, 23 nt, Artificial Sequence
  source: /note="Description of Artificial Sequence: Synthetic oligonucleotide"
ucuccaauaaguuuuggucgaug

SEQ ID NO: 269 - RNA, 23 nt, Artificial Sequence
  source: /note="Description of Artificial Sequence: Synthetic oligonucleotide"
uucuccaauaaguuuuggucgau

SEQ ID NO: 270 - RNA, 23 nt, Artificial Sequence
  source: /note="Description of Artificial Sequence: Synthetic oligonucleotide"
uuuucaaaguaggcuucucgucu

SEQ ID NO: 271 - RNA, 23 nt, Artificial Sequence
  source: /note="Description of Artificial Sequence: Synthetic oligonucleotide"
uuuuucaaaguaggcuucucguc

SEQ ID NO: 272 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucacctagaucacucccaagug

SEQ ID NO: 273 - RNA, 23 nt, Artificial Sequence
  source: /note="Description of Artificial Sequence: Synthetic oligonucleotide"
aaucaccuagaucacucccaagu

SEQ ID NO: 274 - RNA, 23 nt, Artificial Sequence
  source: /note="Description of Artificial Sequence: Synthetic oligonucleotide"
uagcaucaccuagaucacuccca

SEQ ID NO: 275 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagcatcaccuagaucacuccc

SEQ ID NO: 276 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaguutcuaaagacauggucac

SEQ ID NO: 277 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacagutucuaaagacaugguca

SEQ ID NO: 278 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacagtuucuaaagacaugguc

SEQ ID NO: 279 - RNA, 23 nt, Artificial Sequence
  source: /note="Description of Artificial Sequence: Synthetic oligonucleotide"
augacaguuucuaaagacauggu

SEQ ID NO: 280 - RNA, 23 nt, Artificial Sequence
  source: /note="Description of Artificial Sequence: Synthetic oligonucleotide"
uucugacaguuucuaaagacaug

SEQ ID NO: 281 - RNA, 23 nt, Artificial Sequence
  source: /note="Description of Artificial Sequence: Synthetic oligonucleotide"
uuucugacaguuucuaaagacau

SEQ ID NO: 282 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuguutucaaaucauuucugac

SEQ ID NO: 283 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuuctguuuucaaaucauuuc

SEQ ID NO: 284 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuguutgcaaaccgcuaaaagu

SEQ ID NO: 285 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuugutugcaaaccgcuaaaag

SEQ ID NO: 286 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuugtuugcaaaccgcuaaaa

SEQ ID NO: 287 - RNA, 23 nt, Artificial Sequence
  source: /note="Description of Artificial Sequence: Synthetic oligonucleotide"
aauuuuguuugcaaaccgcuaaa

SEQ ID NO: 288 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauuutguuugcaaaccgcuaa

SEQ ID NO: 289 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucauutuguuugcaaaccgcua

SEQ ID NO: 290 - RNA, 23 nt, Artificial Sequence
  source: /note="Description of Artificial Sequence: Synthetic oligonucleotide"
accaucauuuuguuugcaaaccg

SEQ ID NO: 291 - RNA, 23 nt, Artificial Sequence
  source: /note="Description of Artificial Sequence: Synthetic oligonucleotide"
ucccaucauuuuguuugcaaacc

SEQ ID NO: 292 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augucutuaauugcugaaugccu

SEQ ID NO: 293 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauguctuuaauugcugaaugcc

SEQ ID NO: 294 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuaautagcuagucugcaaaaa

SEQ ID NO: 295 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcuaatuagcuagucugcaaaa

SEQ ID NO: 296 - RNA, 23 nt, Artificial Sequence
  source: /note="Description of Artificial Sequence: Synthetic oligonucleotide"
aagcuaauuagcuagucugcaaa

SEQ ID NO: 297 - RNA, 23 nt, Artificial Sequence
  source: /note="Description of Artificial Sequence: Synthetic oligonucleotide"
agagcuaauuagcuagucugcaa

SEQ ID NO: 298 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagagctaauuagcuagucugca

SEQ ID NO: 299 - RNA, 23 nt, Artificial Sequence
  source: /note="Description of Artificial Sequence: Synthetic oligonucleotide"
accauuacuauuaucaacaucag

SEQ ID NO: 300 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaccautacuauuaucaacauca

SEQ ID NO: 301 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaccatuacuauuaucaacauc

SEQ ID NO: 302 - RNA, 23 nt, Artificial Sequence
  source: /note="Description of Artificial Sequence: Synthetic oligonucleotide"
agaaccauuacuauuaucaacau

SEQ ID NO: 303 - RNA, 23 nt, Artificial Sequence
  source: /note="Description of Artificial Sequence: Synthetic oligonucleotide"
uagaaccauuacuauuaucaaca

SEQ ID NO: 304 - RNA, 23 nt, Artificial Sequence
  source: /note="Description of Artificial Sequence: Synthetic oligonucleotide"
auagaaccauuacuauuaucaac

SEQ ID NO: 305 - RNA, 23 nt, Artificial Sequence
  source: /note="Description of Artificial Sequence: Synthetic oligonucleotide"
augaaaaccagguagcagaaaag

SEQ ID NO: 306 - RNA, 23 nt, Artificial Sequence
  source: /note="Description of Artificial Sequence: Synthetic oligonucleotide"
aaugaaaaccagguagcagaaaa

SEQ ID NO: 307 - RNA, 23 nt, Artificial Sequence
  source: /note="Description of Artificial Sequence: Synthetic oligonucleotide"
uaaugaaaaccagguagcagaaa

SEQ ID NO: 308 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauaatgaaaaccagguagcag

SEQ ID NO: 309 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaaataaugaaaaccagguag

SEQ ID NO: 310 - RNA, 23 nt, Artificial Sequence
  source: /note="Description of Artificial Sequence: Synthetic oligonucleotide"
aggaaaauaaugaaaaccaggua

SEQ ID NO: 311 - RNA, 23 nt, Artificial Sequence
  source: /note="Description of Artificial Sequence: Synthetic oligonucleotide"
ugggaaaauaaugaaaaccaggu

SEQ ID NO: 312 - RNA, 23 nt, Artificial Sequence
  source: /note="Description of Artificial Sequence: Synthetic oligonucleotide"
augggaaaauaaugaaaaccagg

SEQ ID NO: 313 - RNA, 23 nt, Artificial Sequence
  source: /note="Description of Artificial Sequence: Synthetic oligonucleotide"
ugugggaaaauaaugaaaaccag

SEQ ID NO: 314 - RNA, 23 nt, Artificial Sequence
  source: /note="Description of Artificial Sequence: Synthetic oligonucleotide"
auugugggaaaauaaugaaaacc

SEQ ID NO: 315 - RNA, 23 nt, Artificial Sequence
  source: /note="Description of Artificial Sequence: Synthetic oligonucleotide"
aauugugggaaaauaaugaaaac

SEQ ID NO: 316 - RNA, 23 nt, Artificial Sequence
  source: /note="Description of Artificial Sequence: Synthetic oligonucleotide"
agaauugugggaaaauaaugaaa

SEQ ID NO: 317 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagaatugugggaaaauaauga

SEQ ID NO: 318 - RNA, 23 nt, Artificial Sequence
  source: /note="Description of Artificial Sequence: Synthetic oligonucleotide"
aaaagaauugugggaaaauaaug

SEQ ID NO: 319 - RNA, 23 nt, Artificial Sequence
  source: /note="Description of Artificial Sequence: Synthetic oligonucleotide"
caaaagaauugugggaaaauaau

SEQ ID NO: 320 - RNA, 23 nt, Artificial Sequence
  source: /note="Description of Artificial Sequence: Synthetic oligonucleotide"
ucaaaagaauugugggaaaauaa

SEQ ID NO: 321 - RNA, 23 nt, Artificial Sequence
  source: /note="Description of Artificial Sequence: Synthetic oligonucleotide"
uucaaaagaauugugggaaaaua

SEQ ID NO: 322 - RNA, 23 nt, Artificial Sequence
  source: /note="Description of Artificial Sequence: Synthetic oligonucleotide"
uuucaaaagaauugugggaaaau

SEQ ID NO: 323 - RNA, 23 nt, Artificial Sequence
  source: /note="Description of Artificial Sequence: Synthetic oligonucleotide"
auuucaaaagaauugugggaaaa

SEQ ID NO: 324 - RNA, 23 nt, Artificial Sequence
  source: /note="Description of Artificial Sequence: Synthetic oligonucleotide"
ucuuucaaaagaauugugggaaa

SEQ ID NO: 325 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucuutcaaaagaauuguggga

SEQ ID NO: 326 - RNA, 23 nt, Artificial Sequence
  source: /note="Description of Artificial Sequence: Synthetic oligonucleotide"
aagauuaccaucuuucaaaagaa

SEQ ID NO: 327 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagautaccaucuuucaaaaga

SEQ ID NO: 328 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaagatuaccaucuuucaaaag

SEQ ID NO: 329 - RNA, 23 nt, Artificial Sequence
  source: /note="Description of Artificial Sequence: Synthetic oligonucleotide"
gaaaagauuaccaucuuucaaaa

SEQ ID NO: 330 - RNA, 23 nt, Artificial Sequence
  source: /note="Description of Artificial Sequence: Synthetic oligonucleotide"
agaaaagauuaccaucuuucaaa

SEQ ID NO: 331 - RNA, 23 nt, Artificial Sequence
  source: /note="Description of Artificial Sequence: Synthetic oligonucleotide"
aagaaaagauuaccaucuuucaa

SEQ ID NO: 332 - RNA, 23 nt, Artificial Sequence
  source: /note="Description of Artificial Sequence: Synthetic oligonucleotide"
ucagaaaagauuaccaucuuuca

SEQ ID NO: 333 - RNA, 23 nt, Artificial Sequence
  source: /note="Description of Artificial Sequence: Synthetic oligonucleotide"
aaguuuaggaacgcaccagucau

SEQ ID NO: 334 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagagutuaggaacgcaccaguc

SEQ ID NO: 335 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagagtuuaggaacgcaccagu

SEQ ID NO: 336 - RNA, 23 nt, Artificial Sequence
  source: /note="Description of Artificial Sequence: Synthetic oligonucleotide"
uucagaguuuaggaacgcaccag

SEQ ID NO: 337 - RNA, 23 nt, Artificial Sequence
  source: /note="Description of Artificial Sequence: Synthetic oligonucleotide"
uuucagaguuuaggaacgcacca

SEQ ID NO: 338 - RNA, 23 nt, Artificial Sequence
  source: /note="Description of Artificial Sequence: Synthetic oligonucleotide"
auuucagaguuuaggaacgcacc

SEQ ID NO: 339 - RNA, 23 nt, Artificial Sequence
  source: /note="Description of Artificial Sequence: Synthetic oligonucleotide"
aacaugcucacacauuuuaaaaa

SEQ ID NO: 340 - RNA, 23 nt, Artificial Sequence
  source: /note="Description of Artificial Sequence: Synthetic oligonucleotide"
acacaugcucacacauuuuaaaa

SEQ ID NO: 341 - RNA, 23 nt, Artificial Sequence
  source: /note="Description of Artificial Sequence: Synthetic oligonucleotide"
augggaaagcacaugcucacaca

SEQ ID NO: 342 - RNA, 23 nt, Artificial Sequence
  source: /note="Description of Artificial Sequence: Synthetic oligonucleotide"
ucugggaaagcacaugcucacac

SEQ ID NO: 343 - RNA, 23 nt, Artificial Sequence
  source: /note="Description of Artificial Sequence: Synthetic oligonucleotide"
aaucugggaaagcacaugcucac

SEQ ID NO: 344 - RNA, 23 nt, Artificial Sequence
  source: /note="Description of Artificial Sequence: Synthetic oligonucleotide"
acaucugggaaagcacaugcuca

SEQ ID NO: 345 - RNA, 23 nt, Artificial Sequence
  source: /note="Description of Artificial Sequence: Synthetic oligonucleotide"
aagcaucugggaaagcacaugcu

SEQ ID NO: 346 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagcatcugggaaagcacaugc

SEQ ID NO: 347 - RNA, 23 nt, Artificial Sequence
  source: /note="Description of Artificial Sequence: Synthetic oligonucleotide"
uaaagcaucugggaaagcacaug

SEQ ID NO: 348 - RNA, 23 nt, Artificial Sequence
  source: /note="Description of Artificial Sequence: Synthetic oligonucleotide"
ucauaaagcaucugggaaagcac

SEQ ID NO: 349 - RNA, 23 nt, Artificial Sequence
  source: /note="Description of Artificial Sequence: Synthetic oligonucleotide"
uucauaaagcaucugggaaagca

SEQ ID NO: 350 - RNA, 23 nt, Artificial Sequence
  source: /note="Description of Artificial Sequence: Synthetic oligonucleotide"
auucauaaagcaucugggaaagc

SEQ ID NO: 351 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauucataaagcaucugggaaag

SEQ ID NO: 352 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagguutugauauaagugaaaag

SEQ ID NO: 353 - RNA, 23 nt, Artificial Sequence
  source: /note="Description of Artificial Sequence: Synthetic oligonucleotide"
uguaagguuuugauauaagugaa

SEQ ID NO: 354 - RNA, 23 nt, Artificial Sequence
  source: /note="Description of Artificial Sequence: Synthetic oligonucleotide"
acuguaagguuuugauauaagug

SEQ ID NO: 355 - RNA, 23 nt, Artificial Sequence
  source: /note="Description of Artificial Sequence: Synthetic oligonucleotide"
agcuguaagguuuugauauaagu

SEQ ID NO: 356 - RNA, 23 nt, Artificial Sequence
  source: /note="Description of Artificial Sequence: Synthetic oligonucleotide"
aaagcuguaagguuuugauauaa

SEQ ID NO: 357 - RNA, 23 nt, Artificial Sequence
  source: /note="Description of Artificial Sequence: Synthetic oligonucleotide"
acaaagcuguaagguuuugauau

SEQ ID NO: 358 - RNA, 23 nt, Artificial Sequence
  source: /note="Description of Artificial Sequence: Synthetic oligonucleotide"
aacaaagcuguaagguuuugaua

SEQ ID NO: 359 - RNA, 23 nt, Artificial Sequence
  source: /note="Description of Artificial Sequence: Synthetic oligonucleotide"
aaacaaagcuguaagguuuugau

SEQ ID NO: 360 - RNA, 23 nt, Artificial Sequence
  source: /note="Description of Artificial Sequence: Synthetic oligonucleotide"
acaacaaagcuguaagguuuuga

SEQ ID NO: 361 - RNA, 23 nt, Artificial Sequence
  source: /note="Description of Artificial Sequence: Synthetic oligonucleotide"
ugcaacaaagcuguaagguuuug

SEQ ID NO: 362 - RNA, 23 nt, Artificial Sequence
  source: /note="Description of Artificial Sequence: Synthetic oligonucleotide"
uugcaacaaagcuguaagguuuu

SEQ ID NO: 363 - RNA, 23 nt, Artificial Sequence
  source: /note="Description of Artificial Sequence: Synthetic oligonucleotide"
auugcaacaaagcuguaagguuu

SEQ ID NO: 364 - RNA, 23 nt, Artificial Sequence
  source: /note="Description of Artificial Sequence: Synthetic oligonucleotide"
aguugcaacaaagcuguaagguu

SEQ ID NO: 365 - RNA, 23 nt, Artificial Sequence
  source: /note="Description of Artificial Sequence: Synthetic oligonucleotide"
agguugcaacaaagcuguaaggu

SEQ ID NO: 366 - RNA, 23 nt, Artificial Sequence
  source: /note="Description of Artificial Sequence: Synthetic oligonucleotide"
aaaauaaggcgcaggaagaaggg

SEQ ID NO: 367 - RNA, 23 nt, Artificial Sequence
  source: /note="Description of Artificial Sequence: Synthetic oligonucleotide"
aaaaauaaggcgcaggaagaagg

SEQ ID NO: 368 - RNA, 23 nt, Artificial Sequence
  source: /note="Description of Artificial Sequence: Synthetic oligonucleotide"
uucucaauuggagaagaaaggaa

SEQ ID NO: 369 - RNA, 23 nt, Artificial Sequence
  source: /note="Description of Artificial Sequence: Synthetic oligonucleotide"
uuucucaauuggagaagaaagga

SEQ ID NO: 370 - RNA, 23 nt, Artificial Sequence
  source: /note="Description of Artificial Sequence: Synthetic oligonucleotide"
uuuucucaauuggagaagaaagg

SEQ ID NO: 371 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuuctcaauuggagaagaaag

SEQ ID NO: 372 - RNA, 23 nt, Artificial Sequence
  source: /note="Description of Artificial Sequence: Synthetic oligonucleotide"
agaauucaaguuaaaccacugcu

SEQ ID NO: 373 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaautcaaguuaaaccacugc

SEQ ID NO: 374 - RNA, 23 nt, Artificial Sequence
  source: /note="Description of Artificial Sequence: Synthetic oligonucleotide"
aauucaaguuaaaccacugcuug

SEQ ID NO: 375 - RNA, 23 nt, Artificial Sequence
  source: /note="Description of Artificial Sequence: Synthetic oligonucleotide"
aaauucaaguuaaaccacugcuu

SEQ ID NO: 376 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaauatagaauaaccuucuugc

SEQ ID NO: 377 - RNA, 23 nt, Artificial Sequence
  source: /note="Description of Artificial Sequence: Synthetic oligonucleotide"
acaaauauagaauaaccuucuug

SEQ ID NO: 378 - RNA, 23 nt, Artificial Sequence
  source: /note="Description of Artificial Sequence: Synthetic oligonucleotide"
aucuccaauaaguuuuggucgau

SEQ ID NO: 379 - RNA, 23 nt, Artificial Sequence
  source: /note="Description of Artificial Sequence: Synthetic oligonucleotide"
auuuucaaaguaggcuucucguc

SEQ ID NO: 380 - RNA, 23 nt, Artificial Sequence
  source: /note="Description of Artificial Sequence: Synthetic oligonucleotide"
uuucucguggaagauggacucca

SEQ ID NO: 381 - RNA, 23 nt, Artificial Sequence
  source: /note="Description of Artificial Sequence: Synthetic oligonucleotide"
uauguuuauuugucuggagccaa

SEQ ID NO: 382 - RNA, 23 nt, Artificial Sequence
  source: /note="Description of Artificial Sequence: Synthetic oligonucleotide"
uagauggacuccauguuuauuug

SEQ ID NO: 383 - RNA, 23 nt, Artificial Sequence
  source: /note="Description of Artificial Sequence: Synthetic oligonucleotide"
uuuucucguggaagauggacucc

SEQ ID NO: 384 - RNA, 23 nt, Artificial Sequence
  source: /note="Description of Artificial Sequence: Synthetic oligonucleotide"
ugcuaaaauacucuccuugcaau

SEQ ID NO: 385 - RNA, 23 nt, Artificial Sequence
  source: /note="Description of Artificial Sequence: Synthetic oligonucleotide"
uggcuaaaauacucuccuugcaa

SEQ ID NO: 386 - RNA, 23 nt, Artificial Sequence
  source: /note="Description of Artificial Sequence: Synthetic oligonucleotide"
uaaaaaugugcgguagucuucac

SEQ ID NO: 387 - RNA, 23 nt, Artificial Sequence
  source: /note="Description of Artificial Sequence: Synthetic oligonucleotide"
uguaaaaaugugcgguagucuuc

SEQ ID NO: 388 - RNA, 23 nt, Artificial Sequence
  source: /note="Description of Artificial Sequence: Synthetic oligonucleotide"
ugcuguaaaaaugugcgguaguc

SEQ ID NO: 389 - RNA, 23 nt, Artificial Sequence
  source: /note="Description of Artificial Sequence: Synthetic oligonucleotide"
uaaaugugcgguagucuucacua

SEQ ID NO: 390 - RNA, 23 nt, Artificial Sequence
  source: /note="Description of Artificial Sequence: Synthetic oligonucleotide"
uaaaaugugcgguagucuucacu

SEQ ID NO: 391 - RNA, 23 nt, Artificial Sequence
  source: /note="Description of Artificial Sequence: Synthetic oligonucleotide"
uuaaaaaugugcgguagucuuca

SEQ ID NO: 392 - RNA, 23 nt, Artificial Sequence
  source: /note="Description of Artificial Sequence: Synthetic oligonucleotide"
ucuguaaaaaugugcgguagucu

SEQ ID NO: 393 - RNA, 23 nt, Artificial Sequence
  source: /note="Description of Artificial Sequence: Synthetic oligonucleotide"
uugcuguaaaaaugugcgguagu

SEQ ID NO: 394 - RNA, 23 nt, Artificial Sequence
  source: /note="Description of Artificial Sequence: Synthetic oligonucleotide"
ugcugcuguaaaaaugugcggua

SEQ ID NO: 395 - RNA, 23 nt, Artificial Sequence
  source: /note="Description of Artificial Sequence: Synthetic oligonucleotide"
uauauuuccagaaggcugcugua

SEQ ID NO: 396 - RNA, 23 nt, Artificial Sequence
  source: /note="Description of Artificial Sequence: Synthetic oligonucleotide"
ugaauagagaaaaagccgcuguc

SEQ ID NO: 397 - RNA, 23 nt, Artificial Sequence
  source: /note="Description of Artificial Sequence: Synthetic oligonucleotide"
ugcuuauaacuugaauagagaaa

SEQ ID NO: 398 - RNA, 23 nt, Artificial Sequence
  source: /note="Description of Artificial Sequence: Synthetic oligonucleotide"
uugcuuauaacuugaauagagaa

SEQ ID NO: 399 - RNA, 23 nt, Artificial Sequence
  source: /note="Description of Artificial Sequence: Synthetic oligonucleotide"
uuagagaaaaagccgcugucauc

SEQ ID NO: 400 - RNA, 23 nt, Artificial Sequence
  source: /note="Description of Artificial Sequence: Synthetic oligonucleotide"
uuugaauagagaaaaagccgcug

SEQ ID NO: 401 - RNA, 23 nt, Artificial Sequence
  source: /note="Description of Artificial Sequence: Synthetic oligonucleotide"
ucauugcuuauaacuugaauaga

SEQ ID NO: 402 - RNA, 23 nt, Artificial Sequence
  source: /note="Description of Artificial Sequence: Synthetic oligonucleotide"
uaauugcauauaaaggaucuuuc

SEQ ID NO: 403 - RNA, 23 nt, Artificial Sequence
  source: /note="Description of Artificial Sequence: Synthetic oligonucleotide"
uucuaacuguaaaccaguguucu

SEQ ID NO: 404 - RNA, 23 nt, Artificial Sequence
  source: /note="Description of Artificial Sequence: Synthetic oligonucleotide"
uuucuaacuguaaaccaguguuc

SEQ ID NO: 405 - RNA, 23 nt, Artificial Sequence
  source: /note="Description of Artificial Sequence: Synthetic oligonucleotide"
uauugcauauaaaggaucuuucg

SEQ ID NO: 406 - RNA, 23 nt, Artificial Sequence
  source: /note="Description of Artificial Sequence: Synthetic oligonucleotide"
uaccaguguucuuuauaauugca

SEQ ID NO: 407 - RNA, 23 nt, Artificial Sequence
  source: /note="Description of Artificial Sequence: Synthetic oligonucleotide"
uacuguaaaccaguguucuuuau

SEQ ID NO: 408 - RNA, 23 nt, Artificial Sequence
  source: /note="Description of Artificial Sequence: Synthetic oligonucleotide"
uuaacuguaaaccaguguucuuu

SEQ ID NO: 409 - RNA, 23 nt, Artificial Sequence
  source: /note="Description of Artificial Sequence: Synthetic oligonucleotide"
uauucaaguuaaaccacugcuug

SEQ ID NO: 410 - RNA, 23 nt, Artificial Sequence
  source: /note="Description of Artificial Sequence: Synthetic oligonucleotide"
uagaauaaccuucuugcuguaau

SEQ ID NO: 411 - RNA, 23 nt, Artificial Sequence
  source: /note="Description of Artificial Sequence: Synthetic oligonucleotide"
uauaaccuucuugcuguaauuga

SEQ ID NO: 412 - RNA, 23 nt, Artificial Sequence
  source: /note="Description of Artificial Sequence: Synthetic oligonucleotide"
uaauaaccuucuugcuguaauug

SEQ ID NO: 413 - RNA, 23 nt, Artificial Sequence
  source: /note="Description of Artificial Sequence: Synthetic oligonucleotide"
uuagaauaaccuucuugcuguaa

SEQ ID NO: 414 - RNA, 23 nt, Artificial Sequence
  source: /note="Description of Artificial Sequence: Synthetic oligonucleotide"
uuauagaauaaccuucuugcugu

SEQ ID NO: 415 - RNA, 23 nt, Artificial Sequence
  source: /note="Description of Artificial Sequence: Synthetic oligonucleotide"
uauauagaauaaccuucuugcug

SEQ ID NO: 416 - RNA, 23 nt, Artificial Sequence
  source: /note="Description of Artificial Sequence: Synthetic oligonucleotide"
uaauauagaauaaccuucuugcu

SEQ ID NO: 417 - RNA, 23 nt, Artificial Sequence
  source: /note="Description of Artificial Sequence: Synthetic oligonucleotide"
ucaaucuggcagaucacccuuaa

SEQ ID NO: 418 - RNA, 23 nt, Artificial Sequence
  source: /note="Description of Artificial Sequence: Synthetic oligonucleotide"
uaaaguuggucagcuucacaauc

SEQ ID NO: 419 - RNA, 23 nt, Artificial Sequence
  source: /note="Description of Artificial Sequence: Synthetic oligonucleotide"
uaaaaguuggucagcuucacaau

SEQ ID NO: 420 - RNA, 23 nt, Artificial Sequence
  source: /note="Description of Artificial Sequence: Synthetic oligonucleotide"
uuuuggucgaugcaucuguugga

SEQ ID NO: 421 - RNA, 23 nt, Artificial Sequence
  source: /note="Description of Artificial Sequence: Synthetic oligonucleotide"
uaaguuuuggucgaugcaucugu

SEQ ID NO: 422 - RNA, 23 nt, Artificial Sequence
  source: /note="Description of Artificial Sequence: Synthetic oligonucleotide"
ucuccaauaaguuuuggucgaug

SEQ ID NO: 423 - RNA, 23 nt, Artificial Sequence
  source: /note="Description of Artificial Sequence: Synthetic oligonucleotide"
uuguuggaccuugaucaucugca

SEQ ID NO: 424 - RNA, 23 nt, Artificial Sequence
  source: /note="Description of Artificial Sequence: Synthetic oligonucleotide"
uucuguuggaccuugaucaucug

SEQ ID NO: 425 - RNA, 23 nt, Artificial Sequence
  source: /note="Description of Artificial Sequence: Synthetic oligonucleotide"
uaucuguuggaccuugaucaucu

SEQ ID NO: 426 - RNA, 23 nt, Artificial Sequence
  source: /note="Description of Artificial Sequence: Synthetic oligonucleotide"
uguuuuggucgaugcaucuguug

SEQ ID NO: 427 - RNA, 23 nt, Artificial Sequence
  source: /note="Description of Artificial Sequence: Synthetic oligonucleotide"
uaguuuuggucgaugcaucuguu

SEQ ID NO: 428 - RNA, 23 nt, Artificial Sequence
  source: /note="Description of Artificial Sequence: Synthetic oligonucleotide"
uuaaguuuuggucgaugcaucug

SEQ ID NO: 429 - RNA, 23 nt, Artificial Sequence
  source: /note="Description of Artificial Sequence: Synthetic oligonucleotide"
uauaaguuuuggucgaugcaucu

SEQ ID NO: 430 - RNA, 23 nt, Artificial Sequence
  source: /note="Description of Artificial Sequence: Synthetic oligonucleotide"
uuccaauaaguuuuggucgaugc

SEQ ID NO: 431 - RNA, 23 nt, Artificial Sequence
  source: /note="Description of Artificial Sequence: Synthetic oligonucleotide"
uucuggaacuaccuugcauacug

SEQ ID NO: 432 - RNA, 23 nt, Artificial Sequence
  source: /note="Description of Artificial Sequence: Synthetic oligonucleotide"
uuaccuugcauacugagcugaau

SEQ ID NO: 433 - RNA, 23 nt, Artificial Sequence
  source: /note="Description of Artificial Sequence: Synthetic oligonucleotide"
ucuaccuugcauacugagcugaa

SEQ ID NO: 434 - RNA, 23 nt, Artificial Sequence
  source: /note="Description of Artificial Sequence: Synthetic oligonucleotide"
uaacuaccuugcauacugagcug

SEQ ID NO: 435 - RNA, 23 nt, Artificial Sequence
  source: /note="Description of Artificial Sequence: Synthetic oligonucleotide"
ugcuguugcuuuucaaaguaggc

SEQ ID NO: 436 - RNA, 23 nt, Artificial Sequence
  source: /note="Description of Artificial Sequence: Synthetic oligonucleotide"
ucuuucugcuuacaaaccacuac

SEQ ID NO: 437 - RNA, 23 nt, Artificial Sequence
  source: /note="Description of Artificial Sequence: Synthetic oligonucleotide"
uuucauugcugacugccucuuug

SEQ ID NO: 438 - RNA, 23 nt, Artificial Sequence
  source: /note="Description of Artificial Sequence: Synthetic oligonucleotide"
ucagucagauauugcacauuuga

SEQ ID NO: 439 - RNA, 23 nt, Artificial Sequence
  source: /note="Description of Artificial Sequence: Synthetic oligonucleotide"
uucagucagauauugcacauuug

SEQ ID NO: 440 - RNA, 23 nt, Artificial Sequence
  source: /note="Description of Artificial Sequence: Synthetic oligonucleotide"
uccauaauuucagucagauauug

SEQ ID NO: 441 - RNA, 23 nt, Artificial Sequence
  source: /note="Description of Artificial Sequence: Synthetic oligonucleotide"
uucagauauugcacauuugaaaa

SEQ ID NO: 442 - RNA, 23 nt, Artificial Sequence
  source: /note="Description of Artificial Sequence: Synthetic oligonucleotide"
ugucagauauugcacauuugaaa

SEQ ID NO: 443 - RNA, 23 nt, Artificial Sequence
  source: /note="Description of Artificial Sequence: Synthetic oligonucleotide"
ucauaauuucagucagauauugc

SEQ ID NO: 444 - RNA, 23 nt, Artificial Sequence
  source: /note="Description of Artificial Sequence: Synthetic oligonucleotide"
ucaaguucuguggcaagagcuaa

SEQ ID NO: 445 - RNA, 23 nt, Artificial Sequence
  source: /note="Description of Artificial Sequence: Synthetic oligonucleotide"
uucaaguucuguggcaagagcua

SEQ ID NO: 446 - RNA, 23 nt, Artificial Sequence
  source: /note="Description of Artificial Sequence: Synthetic oligonucleotide"
uagcagccuauuuucuacuagaa

SEQ ID NO: 447 - RNA, 23 nt, Artificial Sequence
  source: /note="Description of Artificial Sequence: Synthetic oligonucleotide"
ucauccuagcagccuauuuucua

SEQ ID NO: 448 - RNA, 23 nt, Artificial Sequence
  source: /note="Description of Artificial Sequence: Synthetic oligonucleotide"
uuagcagccuauuuucuacuaga

SEQ ID NO: 449 - RNA, 23 nt, Artificial Sequence
  source: /note="Description of Artificial Sequence: Synthetic oligonucleotide"
uauccuagcagccuauuuucuac

SEQ ID NO: 450 - RNA, 23 nt, Artificial Sequence
  source: /note="Description of Artificial Sequence: Synthetic oligonucleotide"
uaauuuccacccaaaucauacca

SEQ ID NO: 451 - RNA, 23 nt, Artificial Sequence
  source: /note="Description of Artificial Sequence: Synthetic oligonucleotide"
uauuuccacccaaaucauaccac

SEQ ID NO: 452 - RNA, 23 nt, Artificial Sequence
  source: /note="Description of Artificial Sequence: Synthetic oligonucleotide"
ucccugauaaaaacgugugcaga

SEQ ID NO: 453 - RNA, 23 nt, Artificial Sequence
  source: /note="Description of Artificial Sequence: Synthetic oligonucleotide"
uucccugauaaaaacgugugcag

SEQ ID NO: 454 - RNA, 23 nt, Artificial Sequence
  source: /note="Description of Artificial Sequence: Synthetic oligonucleotide"
uuucccugauaaaaacgugugca

SEQ ID NO: 455 - RNA, 23 nt, Artificial Sequence
  source: /note="Description of Artificial Sequence: Synthetic oligonucleotide"
uaaaacuuucccugauaaaaacg

SEQ ID NO: 456 - RNA, 23 nt, Artificial Sequence
  source: /note="Description of Artificial Sequence: Synthetic oligonucleotide"
uagcaauaaauccuacauccaaa

SEQ ID NO: 457 - RNA, 23 nt, Artificial Sequence
  source: /note="Description of Artificial Sequence: Synthetic oligonucleotide"
uucugaaccuuugcaauuacuga

SEQ ID NO: 458 - RNA, 23 nt, Artificial Sequence
  source: /note="Description of Artificial Sequence: Synthetic oligonucleotide"
uaagcauuggcaucuuuucauac

SEQ ID NO: 459 - RNA, 23 nt, Artificial Sequence
  source: /note="Description of Artificial Sequence: Synthetic oligonucleotide"
ugcauuggcaucuuuucauacug

SEQ ID NO: 460 - RNA, 23 nt, Artificial Sequence
  source: /note="Description of Artificial Sequence: Synthetic oligonucleotide"
uuacacuuuggauacuguggcua

SEQ ID NO: 461 - RNA, 23 nt, Artificial Sequence
  source: /note="Description of Artificial Sequence: Synthetic oligonucleotide"
uacuuuggcuucaucaagaaaaa

SEQ ID NO: 462 - RNA, 23 nt, Artificial Sequence
  source: /note="Description of Artificial Sequence: Synthetic oligonucleotide"
ucucauuaacuuuggcuucauca

SEQ ID NO: 463 - RNA, 23 nt, Artificial Sequence
  source: /note="Description of Artificial Sequence: Synthetic oligonucleotide"
uuacacuuguuaggacuaaauua

SEQ ID NO: 464 - RNA, 23 nt, Artificial Sequence
  source: /note="Description of Artificial Sequence: Synthetic oligonucleotide"
uagcucuacacuuguuaggacua

SEQ ID NO: 465 - RNA, 23 nt, Artificial Sequence
  source: /note="Description of Artificial Sequence: Synthetic oligonucleotide"
ugcucuacacuuguuaggacuaa

SEQ ID NO: 466 - RNA, 23 nt, Artificial Sequence
  source: /note="Description of Artificial Sequence: Synthetic oligonucleotide"
ugugcuaauucuuaaaaugacag

SEQ ID NO: 467 - RNA, 23 nt, Artificial Sequence
  source: /note="Description of Artificial Sequence: Synthetic oligonucleotide"
uauuccuauuaguccaguguugu

SEQ ID NO: 468 - RNA, 23 nt, Artificial Sequence
  source: /note="Description of Artificial Sequence: Synthetic oligonucleotide"
uuuccuauuaguccaguguugua

SEQ ID NO: 469 - RNA, 23 nt, Artificial Sequence
  source: /note="Description of Artificial Sequence: Synthetic oligonucleotide"
uguuauuccuauuaguccagugu

SEQ ID NO: 470 - RNA, 23 nt, Artificial Sequence
  source: /note="Description of Artificial Sequence: Synthetic oligonucleotide"
uaguuauuccuauuaguccagug

SEQ ID NO: 471 - RNA, 23 nt, Artificial Sequence
  source: /note="Description of Artificial Sequence: Synthetic oligonucleotide"
uaaguuauuccuauuaguccagu

SEQ ID NO: 472 - RNA, 23 nt, Artificial Sequence
  source: /note="Description of Artificial Sequence: Synthetic oligonucleotide"
uaaaaguuauuccuauuagucca

SEQ ID NO: 473 - RNA, 23 nt, Unknown
  source: /note="Description of Unknown: ATXN3 mRNA target sequence"
uuccacgagaaacaagaaggcuc

SEQ ID NO: 474 - RNA, 23 nt, Unknown
  source: /note="Description of Unknown: ATXN3 mRNA target sequence"
uuuacagcagccuucuggaaaua

SEQ ID NO: 475 - RNA, 23 nt, Unknown
  source: /note="Description of Unknown: ATXN3 mRNA target sequence"
uacagcagccuucuggaaauaug

SEQ ID NO: 476 - RNA, 23 nt, Unknown
  source: /note="Description of Unknown: ATXN3 mRNA target sequence"
acagcagccuucuggaaauaugg

SEQ ID NO: 477 - RNA, 23 nt, Unknown
  source: /note="Description of Unknown: ATXN3 mRNA target sequence"
uauucagugguuuaacuugaauu

SEQ ID NO: 478 - RNA, 23 nt, Unknown
  source: /note="Description of Unknown: ATXN3 mRNA target sequence"
auucagugguuuaacuugaauuc

SEQ ID NO: 479 - RNA, 23 nt, Unknown
  source: /note="Description of Unknown: ATXN3 mRNA target sequence"
uucagugguuuaacuugaauucu

SEQ ID NO: 480 - RNA, 23 nt, Unknown
  source: /note="Description of Unknown: ATXN3 mRNA target sequence"
ucagugguuuaacuugaauucuc

SEQ ID NO: 481 - RNA, 23 nt, Unknown
  source: /note="Description of Unknown: ATXN3 mRNA target sequence"
acaggaagguuauucuauauuug

SEQ ID NO: 482 - RNA, 23 nt, Unknown
  source: /note="Description of Unknown: ATXN3 mRNA target sequence"
gcaucgaccaaaacuuauuggag

SEQ ID NO: 483 - RNA, 23 nt, Unknown
  source: /note="Description of Unknown: ATXN3 mRNA target sequence"
caucgaccaaaacuuauuggaga

SEQ ID NO: 484 - RNA, 23 nt, Unknown
  source: /note="Description of Unknown: ATXN3 mRNA target sequence"
aucgaccaaaacuuauuggagaa

SEQ ID NO: 485 - RNA, 23 nt, Unknown
  source: /note="Description of Unknown: ATXN3 mRNA target sequence"
agacgagaagccuacuuugaaaa

SEQ ID NO: 486 - RNA, 23 nt, Unknown
  source: /note="Description of Unknown: ATXN3 mRNA target sequence"
gacgagaagccuacuuugaaaaa

SEQ ID NO: 487 - RNA, 23 nt, Unknown
  source: /note="Description of Unknown: ATXN3 mRNA target sequence"
cguuggcuccagacaaauaaaca

SEQ ID NO: 488 - RNA, 23 nt, Unknown
  source: /note="Description of Unknown: ATXN3 mRNA target sequence"
uuggcuccagacaaauaaacaug

SEQ ID NO: 489 - RNA, 23 nt, Unknown
  source: /note="Description of Unknown: ATXN3 mRNA target sequence"
uggcuccagacaaauaaacaugg

SEQ ID NO: 490 - RNA, 23 nt, Unknown
  source: /note="Description of Unknown: ATXN3 mRNA target sequence"
ggcuccagacaaauaaacaugga

SEQ ID NO: 491 - RNA, 23 nt, Unknown
  source: /note="Description of Unknown: ATXN3 mRNA target sequence"
cuccagacaaauaaacauggagu

SEQ ID NO: 492 - RNA, 23 nt, Unknown
  source: /note="Description of Unknown: ATXN3 mRNA target sequence"
uccagacaaauaaacauggaguc

SEQ ID NO: 493 - RNA, 23 nt, Unknown
  source: /note="Description of Unknown: ATXN3 mRNA target sequence"
ccagacaaauaaacauggagucc

SEQ ID NO: 494 - RNA, 23 nt, Unknown
  source: /note="Description of Unknown: ATXN3 mRNA target sequence"
uggaguccaucuuccacgagaaa

SEQ ID NO: 495 - RNA, 23 nt, Unknown
  source: /note="Description of Unknown: ATXN3 mRNA target sequence"
aguccaucuuccacgagaaacaa

SEQ ID NO: 496 - RNA, 23 nt, Unknown
  source: /note="Description of Unknown: ATXN3 mRNA target sequence"
uccaucuuccacgagaaacaaga

SEQ ID NO: 497 - RNA, 23 nt, Unknown
  source: /note="Description of Unknown: ATXN3 mRNA target sequence"
ccaucuuccacgagaaacaagaa

SEQ ID NO: 498 - RNA, 23 nt, Unknown
  source: /note="Description of Unknown: ATXN3 mRNA target sequence"
aucuuccacgagaaacaagaagg

SEQ ID NO: 499 - RNA, 23 nt, Unknown
  source: /note="Description of Unknown: ATXN3 mRNA target sequence"
ucuuccacgagaaacaagaaggc

SEQ ID NO: 500 - RNA, 23 nt, Unknown
  source: /note="Description of Unknown: ATXN3 mRNA target sequence"
caggaagguuauucuauauuugu

SEQ ID NO: 501 - RNA, 23 nt, Unknown
  source: /note="Description of Unknown: ATXN3 mRNA target sequence"
aggaagguuauucuauauuuguc

SEQ ID NO: 502 - RNA, 23 nt, Unknown
  source: /note="Description of Unknown: ATXN3 mRNA target sequence"
caagaagguuauucuauauuugu

SEQ ID NO: 503 - RNA, 23 nt, Unknown
  source: /note="Description of Unknown: ATXN3 mRNA target sequence"
aucgaccaaaacuuauuggagag

SEQ ID NO: 504 - RNA, 23 nt, Unknown
  source: /note="Description of Unknown: ATXN3 mRNA target sequence"
cuuuugaaagaugguaaucuuuu

SEQ ID NO: 505 - RNA, 23 nt, Unknown
  source: /note="Description of Unknown: ATXN3 mRNA target sequence"
gacgagaagccuacuuugaaaag

SEQ ID NO: 506 - RNA, 23 nt, Unknown
  source: /note="Description of Unknown: ATXN3 mRNA target sequence"
accaugucuuuagaaacugucag

SEQ ID NO: 507 - RNA, 23 nt, Unknown
  source: /note="Description of Unknown: ATXN3 mRNA target sequence"
uuuugaaagaugguaaucuuuuc

SEQ ID NO: 508 - RNA, 23 nt, Unknown
  source: /note="Description of Unknown: ATXN3 mRNA target sequence"
uuugaaagaugguaaucuuuucu

SEQ ID NO: 509 - RNA, 23 nt, Unknown
  source: /note="Description of Unknown: ATXN3 mRNA target sequence"
uugaaagaugguaaucuuuucug

SEQ ID NO: 510 - RNA, 23 nt, Unknown
  source: /note="Description of Unknown: ATXN3 mRNA target sequence"
ugaaagaugguaaucuuuucuga

SEQ ID NO: 511 - RNA, 23 nt, Unknown
  source: /note="Description of Unknown: ATXN3 mRNA target sequence"
augacuggugcguuccuaaacuc

SEQ ID NO: 512 - RNA, 23 nt, Unknown
  source: /note="Description of Unknown: ATXN3 mRNA target sequence"
gacuggugcguuccuaaacucug

SEQ ID NO: 513 - RNA, 23 nt, Unknown
  source: /note="Description of Unknown: ATXN3 mRNA target sequence"
acuggugcguuccuaaacucuga

SEQ ID NO: 514 - RNA, 23 nt, Unknown
  source: /note="Description of Unknown: ATXN3 mRNA target sequence"
uggugcguuccuaaacucugaaa

SEQ ID NO: 515 - RNA, 23 nt, Unknown
  source: /note="Description of Unknown: ATXN3 mRNA target sequence"
ggugcguuccuaaacucugaaau

SEQ ID NO: 516 - RNA, 23 nt, Unknown
  source: /note="Description of Unknown: ATXN3 mRNA target sequence"
uuuuuaaaaugugugagcaugug

SEQ ID NO: 517 - RNA, 23 nt, Unknown
  source: /note="Description of Unknown: ATXN3 mRNA target sequence"
uuuuaaaaugugugagcaugugc

SEQ ID NO: 518 - RNA, 23 nt, Unknown
  source: /note="Description of Unknown: ATXN3 mRNA target sequence"
ugugugagcaugugcuuucccag

SEQ ID NO: 519 - RNA, 23 nt, Unknown
  source: /note="Description of Unknown: ATXN3 mRNA target sequence"
caugucuuuagaaacugucagaa

SEQ ID NO: 520 - RNA, 23 nt, Unknown
  source: /note="Description of Unknown: ATXN3 mRNA target sequence"
augucuuuagaaacugucagaaa

SEQ ID NO: 521 - RNA, 23 nt, Unknown
  source: /note="Description of Unknown: ATXN3 mRNA target sequence"
gucagaaaugauuugaaaacaga

SEQ ID NO: 522 - RNA, 23 nt, Unknown
  source: /note="Description of Unknown: ATXN3 mRNA target sequence"
gaaaugauuugaaaacagaagga

SEQ ID NO: 523 - RNA, 23 nt, Unknown
  source: /note="Description of Unknown: ATXN3 mRNA target sequence"
acuuuuagcgguuugcaaacaaa

SEQ ID NO: 524 - RNA, 23 nt, Unknown
  source: /note="Description of Unknown: ATXN3 mRNA target sequence"
gugugagcaugugcuuucccaga

SEQ ID NO: 525 - RNA, 23 nt, Unknown
  source: /note="Description of Unknown: ATXN3 mRNA target sequence"
gugagcaugugcuuucccagaug

SEQ ID NO: 526 - RNA, 23 nt, Unknown
  source: /note="Description of Unknown: ATXN3 mRNA target sequence"
ugagcaugugcuuucccagaugc

SEQ ID NO: 527 - RNA, 23 nt, Unknown
  source: /note="Description of Unknown: ATXN3 mRNA target sequence"
agcaugugcuuucccagaugcuu

SEQ ID NO: 528 - RNA, 23 nt, Unknown
  source: /note="Description of Unknown: ATXN3 mRNA target sequence"
gcaugugcuuucccagaugcuuu

SEQ ID NO: 529 - RNA, 23 nt, Unknown
  source: /note="Description of Unknown: ATXN3 mRNA target sequence"
cuuuuagcgguuugcaaacaaaa

SEQ ID NO: 530 - RNA, 23 nt, Unknown
  source: /note="Description of Unknown: ATXN3 mRNA target sequence"
uuuuagcgguuugcaaacaaaau

SEQ ID NO: 531 - RNA, 23 nt, Unknown
  source: /note="Description of Unknown: ATXN3 mRNA target sequence"
uuuagcgguuugcaaacaaaaug

SEQ ID NO: 532 - RNA, 23 nt, Unknown
  source: /note="Description of Unknown: ATXN3 mRNA target sequence"
uuagcgguuugcaaacaaaauga

SEQ ID NO: 533 - RNA, 23 nt, Unknown
  source: /note="Description of Unknown: ATXN3 mRNA target sequence"
uagcgguuugcaaacaaaaugau

SEQ ID NO: 534 - RNA, 23 nt, Unknown
  source: /note="Description of Unknown: ATXN3 mRNA target sequence"
cgguuugcaaacaaaaugauggg

SEQ ID NO: 535 - RNA, 23 nt, Unknown
  source: /note="Description of Unknown: ATXN3 mRNA target sequence"
caugugcuuucccagaugcuuua

SEQ ID NO: 536 - RNA, 23 nt, Unknown
  source: /note="Description of Unknown: ATXN3 mRNA target sequence"
gugcuuucccagaugcuuuauga

SEQ ID NO: 537 - RNA, 23 nt, Unknown
  source: /note="Description of Unknown: ATXN3 mRNA target sequence"
ugcuuucccagaugcuuuaugaa

SEQ ID NO: 538 - RNA, 23 nt, Unknown
  source: /note="Description of Unknown: ATXN3 mRNA target sequence"
gcuuucccagaugcuuuaugaau

SEQ ID NO: 539 - RNA, 23 nt, Unknown
  source: /note="Description of Unknown: ATXN3 mRNA target sequence"
gguuugcaaacaaaaugauggga

SEQ ID NO: 540 - RNA, 23 nt, Unknown
  source: /note="Description of Unknown: ATXN3 mRNA target sequence"
aggcauucagcaauuaaagacau

SEQ ID NO: 541 - RNA, 23 nt, Unknown
  source: /note="Description of Unknown: ATXN3 mRNA target sequence"
ggcauucagcaauuaaagacauu

SEQ ID NO: 542 - RNA, 23 nt, Unknown
  source: /note="Description of Unknown: ATXN3 mRNA target sequence"
uuuuugcagacuagcuaauuagc

SEQ ID NO: 543 - RNA, 23 nt, Unknown
  source: /note="Description of Unknown: ATXN3 mRNA target sequence"
uuuugcagacuagcuaauuagcu

SEQ ID NO: 544 - RNA, 23 nt, Unknown
  source: /note="Description of Unknown: ATXN3 mRNA target sequence"
uuugcagacuagcuaauuagcuc

SEQ ID NO: 545 - RNA, 23 nt, Unknown
  source: /note="Description of Unknown: ATXN3 mRNA target sequence"
cuuucccagaugcuuuaugaaug

SEQ ID NO: 546 - RNA, 23 nt, Unknown
  source: /note="Description of Unknown: ATXN3 mRNA target sequence"
cuuuucacuuauaucaaaaccuu

SEQ ID NO: 547 - RNA, 23 nt, Unknown
  source: /note="Description of Unknown: ATXN3 mRNA target sequence"
uugcagacuagcuaauuagcucu

SEQ ID NO: 548 - RNA, 23 nt, Unknown
  source: /note="Description of Unknown: ATXN3 mRNA target sequence"
uucacuuauaucaaaaccuuaca

SEQ ID NO: 549 - RNA, 23 nt, Unknown
  source: /note="Description of Unknown: ATXN3 mRNA target sequence"
cacuuauaucaaaaccuuacagc

SEQ ID NO: 550 - RNA, 23 nt, Unknown
  source: /note="Description of Unknown: ATXN3 mRNA target sequence"
ugcagacuagcuaauuagcucuc

SEQ ID NO: 551 - RNA, 23 nt, Unknown
  source: /note="Description of Unknown: ATXN3 mRNA target sequence"
cugauguugauaauaguaauggu

SEQ ID NO: 552 - RNA, 23 nt, Unknown
  source: /note="Description of Unknown: ATXN3 mRNA target sequence"
ugauguugauaauaguaaugguu

SEQ ID NO: 553 - RNA, 23 nt, Unknown
  source: /note="Description of Unknown: ATXN3 mRNA target sequence"
gauguugauaauaguaaugguuc

SEQ ID NO: 554 - RNA, 23 nt, Unknown
  source: /note="Description of Unknown: ATXN3 mRNA target sequence"
auguugauaauaguaaugguucu

SEQ ID NO: 555 - RNA, 23 nt, Unknown
  source: /note="Description of Unknown: ATXN3 mRNA target sequence"
uguugauaauaguaaugguucua

SEQ ID NO: 556 - RNA, 23 nt, Unknown
  source: /note="Description of Unknown: ATXN3 mRNA target sequence"
guugauaauaguaaugguucuag

SEQ ID NO: 557 - RNA, 23 nt, Unknown
  source: /note="Description of Unknown: ATXN3 mRNA target sequence"
cuuuucugcuaccugguuuucau

SEQ ID NO: 558 - RNA, 23 nt, Unknown
  source: /note="Description of Unknown: ATXN3 mRNA target sequence"
uuuucugcuaccugguuuucauu

SEQ ID NO: 559 - RNA, 23 nt, Unknown
  source: /note="Description of Unknown: ATXN3 mRNA target sequence"
uuucugcuaccugguuuucauua

SEQ ID NO: 560 - RNA, 23 nt, Unknown
  source: /note="Description of Unknown: ATXN3 mRNA target sequence"
cugcuaccugguuuucauuauuu

SEQ ID NO: 561 - RNA, 23 nt, Unknown
  source: /note="Description of Unknown: ATXN3 mRNA target sequence"
cuaccugguuuucauuauuuucc

SEQ ID NO: 562 - RNA, 23 nt, Unknown
  source: /note="Description of Unknown: ATXN3 mRNA target sequence"
uaccugguuuucauuauuuuccc

SEQ ID NO: 563 - RNA, 23 nt, Unknown
  source: /note="Description of Unknown: ATXN3 mRNA target sequence"
acuuauaucaaaaccuuacagcu

SEQ ID NO: 564 - RNA, 23 nt, Unknown
  source: /note="Description of Unknown: ATXN3 mRNA target sequence"
uuauaucaaaaccuuacagcuuu

SEQ ID NO: 565 - RNA, 23 nt, Unknown
  source: /note="Description of Unknown: ATXN3 mRNA target sequence"
auaucaaaaccuuacagcuuugu

SEQ ID NO: 566 - RNA, 23 nt, Unknown
  source: /note="Description of Unknown: ATXN3 mRNA target sequence"
uaucaaaaccuuacagcuuuguu

SEQ ID NO: 567 - RNA, 23 nt, Unknown
  source: /note="Description of Unknown: ATXN3 mRNA target sequence"
aucaaaaccuuacagcuuuguug

SEQ ID NO: 568 - RNA, 23 nt, Unknown
  source: /note="Description of Unknown: ATXN3 mRNA target sequence"
ucaaaaccuuacagcuuuguugc

SEQ ID NO: 569 - RNA, 23 nt, Unknown
  source: /note="Description of Unknown: ATXN3 mRNA target sequence"
accugguuuucauuauuuuccca

SEQ ID NO: 570 - RNA, 23 nt, Unknown
  source: /note="Description of Unknown: ATXN3 mRNA target sequence"
caaaaccuuacagcuuuguugca

SEQ ID NO: 571 - RNA, 23 nt, Unknown
  source: /note="Description of Unknown: ATXN3 mRNA target sequence"
ccugguuuucauuauuuucccac

SEQ ID NO: 572 - RNA, 23 nt, Unknown
  source: /note="Description of Unknown: ATXN3 mRNA target sequence"
aaaaccuuacagcuuuguugcaa

SEQ ID NO: 573 - RNA, 23 nt, Unknown
  source: /note="Description of Unknown: ATXN3 mRNA target sequence"
cugguuuucauuauuuucccaca

SEQ ID NO: 574 - RNA, 23 nt, Unknown
  source: /note="Description of Unknown: ATXN3 mRNA target sequence"
aaaccuuacagcuuuguugcaac

SEQ ID NO: 575 - RNA, 23 nt, Unknown
  source: /note="Description of Unknown: ATXN3 mRNA target sequence"
gguuuucauuauuuucccacaau

SEQ ID NO: 576 - RNA, 23 nt, Unknown
  source: /note="Description of Unknown: ATXN3 mRNA target sequence"
guuuucauuauuuucccacaauu

SEQ ID NO: 577 - RNA, 23 nt, Unknown
  source: /note="Description of Unknown: ATXN3 mRNA target sequence"
aaccuuacagcuuuguugcaacc

SEQ ID NO: 578 - RNA, 23 nt, Unknown
  source: /note="Description of Unknown: ATXN3 mRNA target sequence"
uuucauuauuuucccacaauucu

SEQ ID NO: 579 - RNA, 23 nt, Unknown
  source: /note="Description of Unknown: ATXN3 mRNA target sequence"
ucauuauuuucccacaauucuuu

SEQ ID NO: 580 - RNA, 23 nt, Unknown
  source: /note="Description of Unknown: ATXN3 mRNA target sequence"
accuuacagcuuuguugcaaccc

SEQ ID NO: 581 - RNA, 23 nt, Unknown
  source: /note="Description of Unknown: ATXN3 mRNA target sequence"
cauuauuuucccacaauucuuuu

SEQ ID NO: 582 - RNA, 23 nt, Unknown
  source: /note="Description of Unknown: ATXN3 mRNA target sequence"
cccuucuuccugcgccuuauuuu

SEQ ID NO: 583 - RNA, 23 nt, Unknown
  source: /note="Description of Unknown: ATXN3 mRNA target sequence"
ccuucuuccugcgccuuauuuuu

SEQ ID NO: 584 - RNA, 23 nt, Unknown
  source: /note="Description of Unknown: ATXN3 mRNA target sequence"
uuccuuucuucuccaauugagaa

SEQ ID NO: 585 - RNA, 23 nt, Unknown
  source: /note="Description of Unknown: ATXN3 mRNA target sequence"
uccuuucuucuccaauugagaaa

SEQ ID NO: 586 - RNA, 23 nt, Unknown
  source: /note="Description of Unknown: ATXN3 mRNA target sequence"
ccuuucuucuccaauugagaaaa

SEQ ID NO: 587 - RNA, 23 nt, Unknown
  source: /note="Description of Unknown: ATXN3 mRNA target sequence"
cuuucuucuccaauugagaaaac

SEQ ID NO: 588 - RNA, 23 nt, Unknown
  source: /note="Description of Unknown: ATXN3 mRNA target sequence"
auuauuuucccacaauucuuuug

SEQ ID NO: 589 - RNA, 23 nt, Unknown
  source: /note="Description of Unknown: ATXN3 mRNA target sequence"
uuauuuucccacaauucuuuuga

SEQ ID NO: 590 - RNA, 23 nt, Unknown
  source: /note="Description of Unknown: ATXN3 mRNA target sequence"
uauuuucccacaauucuuuugaa

SEQ ID NO: 591 - RNA, 23 nt, Unknown
  source: /note="Description of Unknown: ATXN3 mRNA target sequence"
agcagugguuuaacuugaauucu

SEQ ID NO: 592 - RNA, 23 nt, Unknown
  source: /note="Description of Unknown: ATXN3 mRNA target sequence"
auuuucccacaauucuuuugaaa

SEQ ID NO: 593 - RNA, 23 nt, Unknown
  source: /note="Description of Unknown: ATXN3 mRNA target sequence"
uuuucccacaauucuuuugaaag

SEQ ID NO: 594 - RNA, 23 nt, Unknown
  source: /note="Description of Unknown: ATXN3 mRNA target sequence"
uuucccacaauucuuuugaaaga

SEQ ID NO: 595 - RNA, 23 nt, Unknown
  source: /note="Description of Unknown: ATXN3 mRNA target sequence"
ucccacaauucuuuugaaagaug

SEQ ID NO: 596 - RNA, 23 nt, Unknown
  source: /note="Description of Unknown: ATXN3 mRNA target sequence"
gcagugguuuaacuugaauucuc

SEQ ID NO: 597 - RNA, 23 nt, Unknown
  source: /note="Description of Unknown: ATXN3 mRNA target sequence"
uucuuuugaaagaugguaaucuu

SEQ ID NO: 598 - RNA, 23 nt, Unknown
  source: /note="Description of Unknown: ATXN3 mRNA target sequence"
caagcagugguuuaacuugaauu

SEQ ID NO: 599 - RNA, 23 nt, Unknown
  source: /note="Description of Unknown: ATXN3 mRNA target sequence"
aagcagugguuuaacuugaauuc

SEQ ID NO: 600 - RNA, 23 nt, Unknown
  source: /note="Description of Unknown: ATXN3 mRNA target sequence"
gcaagaagguuauucuauauuug

SEQ ID NO: 601 - RNA, 23 nt, Unknown
  source: /note="Description of Unknown: ATXN3 mRNA target sequence"
ucuuuugaaagaugguaaucuuu

SEQ ID NO: 602 - RNA, 23 nt, Unknown
  source: /note="Description of Unknown: ATXN3 mRNA target sequence"
acuugggagugaucuaggugaug

SEQ ID NO: 603 - RNA, 23 nt, Unknown
  source: /note="Description of Unknown: ATXN3 mRNA target sequence"
ugggagugaucuaggugaugcua

SEQ ID NO: 604 - RNA, 23 nt, Unknown
  source: /note="Description of Unknown: ATXN3 mRNA target sequence"
cacuugggagugaucuaggugau

SEQ ID NO: 605 - RNA, 23 nt, Unknown
  source: /note="Description of Unknown: ATXN3 mRNA target sequence"
cuggugcguuccuaaacucugaa

SEQ ID NO: 606 - RNA, 23 nt, Unknown
  source: /note="Description of Unknown: ATXN3 mRNA target sequence"
gggagugaucuaggugaugcuau

SEQ ID NO: 607 - RNA, 23 nt, Unknown
  source: /note="Description of Unknown: ATXN3 mRNA target sequence"
gugaccaugucuuuagaaacugu

SEQ ID NO: 608 - RNA, 23 nt, Unknown
  source: /note="Description of Unknown: ATXN3 mRNA target sequence"
ugaccaugucuuuagaaacuguc

SEQ ID NO: 609 - RNA, 23 nt, Unknown
  source: /note="Description of Unknown: ATXN3 mRNA target sequence"
gaccaugucuuuagaaacuguca

SEQ ID NO: 610 - RNA, 23 nt, Unknown
  source: /note="Description of Unknown: ATXN3 mRNA target sequence"
cacuggacuaauaggaauaacuu

SEQ ID NO: 611 - RNA, 23 nt, Unknown
  source: /note="Description of Unknown: ATXN3 mRNA target sequence"
uaguccuaacaaguguagagcua

SEQ ID NO: 612 - RNA, 23 nt, Unknown
  source: /note="Description of Unknown: ATXN3 mRNA target sequence"
uuaguccuaacaaguguagagcu

SEQ ID NO: 613 - RNA, 23 nt, Unknown
  source: /note="Description of Unknown: ATXN3 mRNA target sequence"
acuggacuaauaggaauaacuuu

SEQ ID NO: 614 - RNA, 23 nt, Unknown
  source: /note="Description of Unknown: ATXN3 mRNA target sequence"
agugaagacuaccgcacauuuuu

SEQ ID NO: 615 - RNA, 23 nt, Unknown
  source: /note="Description of Unknown: ATXN3 mRNA target sequence"
ugaagacuaccgcacauuuuuac

SEQ ID NO: 616 - RNA, 23 nt, Unknown
  source: /note="Description of Unknown: ATXN3 mRNA target sequence"
cgaaagauccuuuauaugcaauu

SEQ ID NO: 617 - RNA, 23 nt, Unknown
  source: /note="Description of Unknown: ATXN3 mRNA target sequence"
auaaagaacacugguuuacaguu

SEQ ID NO: 618 - RNA, 23 nt, Unknown
  source: /note="Description of Unknown: ATXN3 mRNA target sequence"
caagcagugguuuaacuugaauu

SEQ ID NO: 619 - RNA, 23 nt, Unknown
  source: /note="Description of Unknown: ATXN3 mRNA target sequence"
agaacacugguuuacaguuagaa

SEQ ID NO: 620 - RNA, 23 nt, Unknown
  source: /note="Description of Unknown: ATXN3 mRNA target sequence"
gaacacugguuuacaguuagaaa

SEQ ID NO: 621 - RNA, 23 nt, Unknown
  source: /note="Description of Unknown: ATXN3 mRNA target sequence"
ugcaauuauaaagaacacugguu

SEQ ID NO: 622 - RNA, 23 nt, Unknown
  source: /note="Description of Unknown: ATXN3 mRNA target sequence"
aaagaacacugguuuacaguuag

SEQ ID NO: 623 - RNA, 23 nt, Unknown
  source: /note="Description of Unknown: ATXN3 mRNA target sequence"
auuacagcaagaagguuauucua

SEQ ID NO: 624 - RNA, 23 nt, Unknown
  source: /note="Description of Unknown: ATXN3 mRNA target sequence"
ucaauuacagcaagaagguuauu

SEQ ID NO: 625 - RNA, 23 nt, Unknown
  source: /note="Description of Unknown: ATXN3 mRNA target sequence"
caauuacagcaagaagguuauuc

SEQ ID NO: 626 - RNA, 23 nt, Unknown
  source: /note="Description of Unknown: ATXN3 mRNA target sequence"
cagcaagaagguuauucuauauu

SEQ ID NO: 627 - RNA, 23 nt, Unknown
  source: /note="Description of Unknown: ATXN3 mRNA target sequence"
uuaagggugaucugccagauugu

SEQ ID NO: 628 - RNA, 23 nt, Unknown
  source: /note="Description of Unknown: ATXN3 mRNA target sequence"
gauugugaagcugaccaacuuuu

SEQ ID NO: 629 - RNA, 23 nt, Unknown
  source: /note="Description of Unknown: ATXN3 mRNA target sequence"
acagcaagaagguuauucuauau

SEQ ID NO: 630 - RNA, 23 nt, Unknown
  source: /note="Description of Unknown: ATXN3 mRNA target sequence"
agcaagaagguuauucuauauuu

SEQ ID NO: 631 - RNA, 23 nt, Unknown
  source: /note="Description of Unknown: ATXN3 mRNA target sequence"
auugugaagcugaccaacuuuug

SEQ ID NO: 632 - RNA, 23 nt, Unknown
  source: /note="Description of Unknown: ATXN3 mRNA target sequence"
caacagaugcaucgaccaaaacu

SEQ ID NO: 633 - RNA, 23 nt, Unknown
  source: /note="Description of Unknown: ATXN3 mRNA target sequence"
gcaucgaccaaaacuuauuggag

SEQ ID NO: 634 - RNA, 23 nt, Unknown
  source: /note="Description of Unknown: ATXN3 mRNA target sequence"
caguaugcaagguaguuccagaa

SEQ ID NO: 635 - RNA, 23 nt, Unknown
  source: /note="Description of Unknown: ATXN3 mRNA target sequence"
agaugaucaagguccaacagaug

SEQ ID NO: 636 - RNA, 23 nt, Unknown
  source: /note="Description of Unknown: ATXN3 mRNA target sequence"
aacagaugcaucgaccaaaacuu

SEQ ID NO: 637 - RNA, 23 nt, Unknown
  source: /note="Description of Unknown: ATXN3 mRNA target sequence"
cagaugcaucgaccaaaacuuau

SEQ ID NO: 638 - RNA, 23 nt, Unknown
  source: /note="Description of Unknown: ATXN3 mRNA target sequence"
agaugcaucgaccaaaacuuauu

SEQ ID NO: 639 - RNA, 23 nt, Unknown
  source: /note="Description of Unknown: ATXN3 mRNA target sequence"
gccuacuuugaaaagcaacagca

SEQ ID NO: 640 - RNA, 23 nt, Unknown
  source: /note="Description of Unknown: ATXN3 mRNA target sequence"
uagcucuugccacagaacuugau

SEQ ID NO: 641 - RNA, 23 nt, Unknown
  source: /note="Description of Unknown: ATXN3 mRNA target sequence"
gcaauaucugacugaaauuaugg

SEQ ID NO: 642 - RNA, 23 nt, Unknown
  source: /note="Description of Unknown: ATXN3 mRNA target sequence"
uuagcucuugccacagaacuuga

SEQ ID NO: 643 - RNA, 23 nt, Unknown
  source: /note="Description of Unknown: ATXN3 mRNA target sequence"
uucuaguagaaaauaggcugcua

SEQ ID NO: 644 - RNA, 23 nt, Unknown
  source: /note="Description of Unknown: ATXN3 mRNA target sequence"
uagaaaauaggcugcuaggauga

SEQ ID NO: 645 - RNA, 23 nt, Unknown
  source: /note="Description of Unknown: ATXN3 mRNA target sequence"
ucuaguagaaaauaggcugcuag

SEQ ID NO: 646 - RNA, 23 nt, Unknown
  source: /note="Description of Unknown: ATXN3 mRNA target sequence"
guagaaaauaggcugcuaggaug

SEQ ID NO: 647 - RNA, 23 nt, Unknown
  source: /note="Description of Unknown: ATXN3 mRNA target sequence"
ugguaugauuuggguggaaauua

SEQ ID NO: 648 - RNA, 23 nt, Unknown
  source: /note="Description of Unknown: ATXN3 mRNA target sequence"
gugguaugauuuggguggaaauu

SEQ ID NO: 649 - RNA, 23 nt, Unknown
  source: /note="Description of Unknown: ATXN3 mRNA target sequence"
ucugcacacguuuuuaucaggga

SEQ ID NO: 650 - RNA, 23 nt, Unknown
  source: /note="Description of Unknown: ATXN3 mRNA target sequence"
uuuggauguaggauuuauugcug

SEQ ID NO: 651 - RNA, 23 nt, Unknown
  source: /note="Description of Unknown: ATXN3 mRNA target sequence"
caguaugaaaagaugccaaugcu

SEQ ID NO: 652 - RNA, 23 nt, Unknown
  source: /note="Description of Unknown: ATXN3 mRNA target sequence"
uaauuuaguccuaacaaguguag

SEQ ID NO: 653 - RNA, 23 nt, Unknown
  source: /note="Description of Unknown: ATXN3 mRNA target sequence"
cugcacacguuuuuaucagggaa

SEQ ID NO: 654 - RNA, 23 nt, Unknown
  source: /note="Description of Unknown: ATXN3 mRNA target sequence"
ugcacacguuuuuaucagggaaa

SEQ ID NO: 655 - RNA, 23 nt, Unknown
  source: /note="Description of Unknown: ATXN3 mRNA target sequence"
cguuuuuaucagggaaaguuuug

SEQ ID NO: 656 - RNA, 23 nt, Unknown
  source: /note="Description of Unknown: ATXN3 mRNA target sequence"
ucaguaauugcaaagguucagaa

SEQ ID NO: 657 - RNA, 23 nt, Unknown
  source: /note="Description of Unknown: ATXN3 mRNA target sequence"
guaugaaaagaugccaaugcuua

SEQ ID NO: 658 - RNA, 23 nt, Unknown
  source: /note="Description of Unknown: ATXN3 mRNA target sequence"
uagccacaguauccaaaguguag

SEQ ID NO: 659 - RNA, 23 nt, Unknown
  source: /note="Description of Unknown: ATXN3 mRNA target sequence"
uuuuucuugaugaagccaaaguu

SEQ ID NO: 660 - RNA, 23 nt, Unknown
  source: /note="Description of Unknown: ATXN3 mRNA target sequence"
ugaugaagccaaaguuaaugagc

SEQ ID NO: 661 - RNA, 23 nt, Unknown
  source: /note="Description of Unknown: ATXN3 mRNA target sequence"
acacuggacuaauaggaauaacu

SEQ ID NO: 662 - RNA, 23 nt, Unknown
  source: /note="Description of Unknown: ATXN3 mRNA target sequence"
cugucauuuuaagaauuagcaca

SEQ ID NO: 663 - RNA, 23 nt, Unknown
  source: /note="Description of Unknown: ATXN3 mRNA target sequence"
acaacacuggacuaauaggaaua

SEQ ID NO: 664 - RNA, 23 nt, Unknown
  source: /note="Description of Unknown: ATXN3 mRNA target sequence"
uacaacacuggacuaauaggaau

SEQ ID NO: 665 - RNA, 23 nt, Unknown
  source: /note="Description of Unknown: ATXN3 mRNA target sequence"
uggacuaauaggaauaacuuuuu

SEQ ID NO: 666 - RNA, 23 nt, Unknown
  source: /note="Description of Unknown: ATXN3 mRNA target sequence"
uggaguccaucuuccacgagaaa

SEQ ID NO: 667 - RNA, 23 nt, Unknown
  source: /note="Description of Unknown: ATXN3 mRNA target sequence"
uuggcuccagacaaauaaacaug

SEQ ID NO: 668 - RNA, 23 nt, Unknown
  source: /note="Description of Unknown: ATXN3 mRNA target sequence"
auugcaaggagaguauuuuagcc

SEQ ID NO: 669 - RNA, 23 nt, Unknown
  source: /note="Description of Unknown: ATXN3 mRNA target sequence"
uugcaaggagaguauuuuagccc

SEQ ID NO: 670 - RNA, 23 nt, Unknown
  source: /note="Description of Unknown: ATXN3 mRNA target sequence"
gaagacuaccgcacauuuuuaca

SEQ ID NO: 671 - RNA, 23 nt, Unknown
  source: /note="Description of Unknown: ATXN3 mRNA target sequence"
caaauaaacauggaguccaucuu

SEQ ID NO: 672 - RNA, 23 nt, Unknown
  source: /note="Description of Unknown: ATXN3 mRNA target sequence"
ggaguccaucuuccacgagaaac

SEQ ID NO: 673 - RNA, 23 nt, Unknown
  source: /note="Description of Unknown: ATXN3 mRNA target sequence"
gugaagacuaccgcacauuuuua

SEQ ID NO: 674 - RNA, 23 nt, Unknown
  source: /note="Description of Unknown: ATXN3 mRNA target sequence"
gacuaccgcacauuuuuacagca

SEQ ID NO: 675 - RNA, 23 nt, Unknown
  source: /note="Description of Unknown: ATXN3 mRNA target sequence"
uagugaagacuaccgcacauuuu

SEQ ID NO: 676 - RNA, 23 nt, Unknown
  source: /note="Description of Unknown: ATXN3 mRNA target sequence"
agacuaccgcacauuuuuacagc

SEQ ID NO: 677 - RNA, 23 nt, Unknown
  source: /note="Description of Unknown: ATXN3 mRNA target sequence"
uacagcagccuucuggaaauaug

SEQ ID NO: 678 - RNA, 23 nt, Unknown
  source: /note="Description of Unknown: ATXN3 mRNA target sequence"
acuaccgcacauuuuuacagcag

SEQ ID NO: 679 - RNA, 23 nt, Unknown
  source: /note="Description of Unknown: ATXN3 mRNA target sequence"
uaccgcacauuuuuacagcagcc

SEQ ID NO: 680 - RNA, 23 nt, Unknown
  source: /note="Description of Unknown: ATXN3 mRNA target sequence"
uuucucuauucaaguuauaagca

SEQ ID NO: 681 - RNA, 23 nt, Unknown
  source: /note="Description of Unknown: ATXN3 mRNA target sequence"
gacagcggcuuuuucucuauuca

SEQ ID NO: 682 - RNA, 23 nt, Unknown
  source: /note="Description of Unknown: ATXN3 mRNA target sequence"
uucucuauucaaguuauaagcaa

SEQ ID NO: 683 - RNA, 23 nt, Unknown
  source: /note="Description of Unknown: ATXN3 mRNA target sequence"
gaugacagcggcuuuuucucuau

SEQ ID NO: 684 - RNA, 23 nt, Unknown
  source: /note="Description of Unknown: ATXN3 mRNA target sequence"
cagcggcuuuuucucuauucaag

SEQ ID NO: 685 - RNA, 23 nt, Unknown
  source: /note="Description of Unknown: ATXN3 mRNA target sequence"
ucuauucaaguuauaagcaaugc

SEQ ID NO: 686 - RNA, 23 nt, Unknown
  source: /note="Description of Unknown: ATXN3 mRNA target sequence"
gaaagauccuuuauaugcaauua

SEQ ID NO: 687 - RNA, 23 nt, Unknown
  source: /note="Description of Unknown: ATXN3 mRNA target sequence"
uuacagcaagaagguuauucuau

SEQ ID NO: 688 - RNA, 23 nt, Unknown
  source: /note="Description of Unknown: ATXN3 mRNA target sequence"
acagaugcaucgaccaaaacuua

SEQ ID NO: 689 - RNA, 23 nt, Unknown
  source: /note="Description of Unknown: ATXN3 mRNA target sequence"
uccaacagaugcaucgaccaaaa

SEQ ID NO: 690 - RNA, 23 nt, Unknown
  source: /note="Description of Unknown: ATXN3 mRNA target sequence"
caucgaccaaaacuuauuggaga

SEQ ID NO: 691 - RNA, 23 nt, Unknown
  source: /note="Description of Unknown: ATXN3 mRNA target sequence"
ugcagaugaucaagguccaacag

SEQ ID NO: 692 - RNA, 23 nt, Unknown
  source: /note="Description of Unknown: ATXN3 mRNA target sequence"
cagaugaucaagguccaacagau

SEQ ID NO: 693 - RNA, 23 nt, Unknown
  source: /note="Description of Unknown: ATXN3 mRNA target sequence"
auucagcucaguaugcaagguag

SEQ ID NO: 694 - RNA, 23 nt, Unknown
  source: /note="Description of Unknown: ATXN3 mRNA target sequence"
cagcucaguaugcaagguaguuc

SEQ ID NO: 695 - RNA, 23 nt, Unknown
  source: /note="Description of Unknown: ATXN3 mRNA target sequence"
uucagcucaguaugcaagguagu

SEQ ID NO: 696 - RNA, 23 nt, Unknown
  source: /note="Description of Unknown: ATXN3 mRNA target sequence"
guagugguuuguaagcagaaagg

SEQ ID NO: 697 - RNA, 23 nt, Unknown
  source: /note="Description of Unknown: ATXN3 mRNA target sequence"
ucaaaugugcaauaucugacuga

SEQ ID NO: 698 - RNA, 23 nt, Unknown
  source: /note="Description of Unknown: ATXN3 mRNA target sequence"
caaagaggcagucagcaaugaaa

SEQ ID NO: 699 - RNA, 23 nt, Unknown
  source: /note="Description of Unknown: ATXN3 mRNA target sequence"
caaaugugcaauaucugacugaa

SEQ ID NO: 700 - RNA, 23 nt, Unknown
  source: /note="Description of Unknown: ATXN3 mRNA target sequence"
caauaucugacugaaauuaugga

SEQ ID NO: 701 - RNA, 23 nt, Unknown
  source: /note="Description of Unknown: ATXN3 mRNA target sequence"
uuuucaaaugugcaauaucugac

SEQ ID NO: 702 - RNA, 23 nt, Unknown
  source: /note="Description of Unknown: ATXN3 mRNA target sequence"
uuucaaaugugcaauaucugacu

SEQ ID NO: 703 - RNA, 21 nt, Artificial Sequence
  source: /note="Description of Artificial Sequence: Synthetic oligonucleotide"
uuggcuccagacaaauaaaca

SEQ ID NO: 704 - RNA, 21 nt, Artificial Sequence
  source: /note="Description of Artificial Sequence: Synthetic oligonucleotide"
ggcuccagacaaauaaacauu

SEQ ID NO: 705 - RNA, 21 nt, Artificial Sequence
  source: /note="Description of Artificial Sequence: Synthetic oligonucleotide"
gcuccagacaaauaaacaugu

SEQ ID NO: 706 - RNA, 21 nt, Artificial Sequence
  source: /note="Description of Artificial Sequence: Synthetic oligonucleotide"
cuccagacaaauaaacaugga

SEQ ID NO: 707 - RNA, 21 nt, Artificial Sequence
  source: /note="Description of Artificial Sequence: Synthetic oligonucleotide"
ccagacaaauaaacauggagu

SEQ ID NO: 708 - RNA, 21 nt, Artificial Sequence
  source: /note="Description of Artificial Sequence: Synthetic oligonucleotide"
cagacaaauaaacauggaguu

SEQ ID NO: 709 - RNA, 21 nt, Artificial Sequence
  source: /note="Description of Artificial Sequence: Synthetic oligonucleotide"
agacaaauaaacauggagucu

SEQ ID NO: 710 - RNA, 21 nt, Artificial Sequence
  source: /note="Description of Artificial Sequence: Synthetic oligonucleotide"
gaguccaucuuccacgagaaa

SEQ ID NO: 711 - RNA, 21 nt, Artificial Sequence
  source: /note="Description of Artificial Sequence: Synthetic oligonucleotide"
uccaucuuccacgagaaacaa

SEQ ID NO: 712 - RNA, 21 nt, Artificial Sequence
  source: /note="Description of Artificial Sequence: Synthetic oligonucleotide"
caucuuccacgagaaacaaga

SEQ ID NO: 713 - RNA, 21 nt, Artificial Sequence
  source: /note="Description of Artificial Sequence: Synthetic oligonucleotide"
aucuuccacgagaaacaagaa

SEQ ID NO: 714 - RNA, 21 nt, Artificial Sequence
  source: /note="Description of Artificial Sequence: Synthetic oligonucleotide"
cuuccacgagaaacaagaagu

SEQ ID NO: 715 - RNA, 21 nt, Artificial Sequence
  source: /note="Description of Artificial Sequence: Synthetic oligonucleotide"
uuccacgagaaacaagaaggu

SEQ ID NO: 716 - RNA, 21 nt, Artificial Sequence
  source: /note="Description of Artificial Sequence: Synthetic oligonucleotide"
ccacgagaaacaagaaggcuu

SEQ ID NO: 717 - RNA, 21 nt, Artificial Sequence
  source: /note="Description of Artificial Sequence: Synthetic oligonucleotide"
uacagcagccuucuggaaaua

SEQ ID NO: 718 - RNA, 21 nt, Artificial Sequence
  source: /note="Description of Artificial Sequence: Synthetic oligonucleotide"
cagcagccuucuggaaauauu

SEQ ID NO: 719 - RNA, 21 nt, Artificial Sequence
  source: /note="Description of Artificial Sequence: Synthetic oligonucleotide"
agcagccuucuggaaauaugu

SEQ ID NO: 720 - RNA, 21 nt, Artificial Sequence
  source: /note="Description of Artificial Sequence: Synthetic oligonucleotide"
uucagugguuuaacuugaauu

SEQ ID NO: 721 - RNA, 21 nt, Artificial Sequence
  source: /note="Description of Artificial Sequence: Synthetic oligonucleotide"
ucagugguuuaacuugaauuu

SEQ ID NO: 722 - RNA, 21 nt, Artificial Sequence
  source: /note="Description of Artificial Sequence: Synthetic oligonucleotide"
cagugguuuaacuugaauucu

SEQ ID NO: 723 - RNA, 21 nt, Artificial Sequence
  source: /note="Description of Artificial Sequence: Synthetic oligonucleotide"
agugguuuaacuugaauucuu

SEQ ID NO: 724 - RNA, 21 nt, Artificial Sequence
  source: /note="Description of Artificial Sequence: Synthetic oligonucleotide"
aggaagguuauucuauauuug

SEQ ID NO: 725 - RNA, 21 nt, Artificial Sequence
  source: /note="Description of Artificial Sequence: Synthetic oligonucleotide"
ggaagguuauucuauauuugu

SEQ ID NO: 726 - RNA, 21 nt, Artificial Sequence
  source: /note="Description of Artificial Sequence: Synthetic oligonucleotide"
gaagguuauucuauauuuguu

SEQ ID NO: 727 - RNA, 21 nt, Artificial Sequence
  source: /note="Description of Artificial Sequence: Synthetic oligonucleotide"
aucgaccaaaacuuauuggau

SEQ ID NO: 728 - RNA, 21 nt, Artificial Sequence
  source: /note="Description of Artificial Sequence: Synthetic oligonucleotide"
ucgaccaaaacuuauuggaga

SEQ ID NO: 729 - RNA, 21 nt, Artificial Sequence
  source: /note="Description of Artificial Sequence: Synthetic oligonucleotide"
cgaccaaaacuuauuggagaa

SEQ ID NO: 730 - RNA, 21 nt, Artificial Sequence
  source: /note="Description of Artificial Sequence: Synthetic oligonucleotide"
acgagaagccuacuuugaaaa

SEQ ID NO: 731 - RNA, 21 nt, Artificial Sequence
  source: /note="Description of Artificial Sequence: Synthetic oligonucleotide"
cgagaagccuacuuugaaaaa

SEQ ID NO: 732 - RNA, 21 nt, Artificial Sequence
  source: /note="Description of Artificial Sequence: Synthetic oligonucleotide"
cuugggagugaucuaggugau

SEQ ID NO: 733 - RNA, 21 nt, Artificial Sequence
  source: /note="Description of Artificial Sequence: Synthetic oligonucleotide"
uugggagugaucuaggugauu

SEQ ID NO: 734 - RNA, 21 nt, Artificial Sequence
  source: /note="Description of Artificial Sequence: Synthetic oligonucleotide"
ggagugaucuaggugaugcua

SEQ ID NO: 735 - RNA, 21 nt, Artificial Sequence
  source: /note="Description of Artificial Sequence: Synthetic oligonucleotide"
gagugaucuaggugaugcuau

SEQ ID NO: 736 - RNA, 21 nt, Artificial Sequence
  source: /note="Description of Artificial Sequence: Synthetic oligonucleotide"
gaccaugucuuuagaaacugu

SEQ ID NO: 737 - RNA, 21 nt, Artificial Sequence
  source: /note="Description of Artificial Sequence: Synthetic oligonucleotide"
accaugucuuuagaaacuguu

SEQ ID NO: 738 - RNA, 21 nt, Artificial Sequence
  source: /note="Description of Artificial Sequence: Synthetic oligonucleotide"
ccaugucuuuagaaacuguca

SEQ ID NO: 739 - RNA, 21 nt, Artificial Sequence
  source: /note="Description of Artificial Sequence: Synthetic oligonucleotide"
caugucuuuagaaacugucau

SEQ ID NO: 740 - RNA, 21 nt, Artificial Sequence
  source: /note="Description of Artificial Sequence: Synthetic oligonucleotide"
ugucuuuagaaacugucagaa

SEQ ID NO: 741 - RNA, 21 nt, Artificial Sequence
  source: /note="Description of Artificial Sequence: Synthetic oligonucleotide"
gucuuuagaaacugucagaaa

SEQ ID NO: 742 - RNA, 21 nt, Artificial Sequence
  source: /note="Description of Artificial Sequence: Synthetic oligonucleotide"
cagaaaugauuugaaaacaga

SEQ ID NO: 743 - RNA, 21 nt, Artificial Sequence
  source: /note="Description of Artificial Sequence: Synthetic oligonucleotide"
aaugauuugaaaacagaagga

SEQ ID NO: 744 - RNA, 21 nt, Artificial Sequence
  source: /note="Description of Artificial Sequence: Synthetic oligonucleotide"
uuuuagcgguuugcaaacaaa

SEQ ID NO: 745 - RNA, 21 nt, Artificial Sequence
  source: /note="Description of Artificial Sequence: Synthetic oligonucleotide"
uuuagcgguuugcaaacaaaa

SEQ ID NO: 746 - RNA, 21 nt, Artificial Sequence
  source: /note="Description of Artificial Sequence: Synthetic oligonucleotide"
uuagcgguuugcaaacaaaau

SEQ ID NO: 747 - RNA, 21 nt, Artificial Sequence
  source: /note="Description of Artificial Sequence: Synthetic oligonucleotide"
uagcgguuugcaaacaaaauu

SEQ ID NO: 748 - RNA, 21 nt, Artificial Sequence
  source: /note="Description of Artificial Sequence: Synthetic oligonucleotide"
agcgguuugcaaacaaaauga

SEQ ID NO: 749 - RNA, 21 nt, Artificial Sequence
  source: /note="Description of Artificial Sequence: Synthetic oligonucleotide"
gcgguuugcaaacaaaaugau

SEQ ID NO: 750 - RNA, 21 nt, Artificial Sequence
  source: /note="Description of Artificial Sequence: Synthetic oligonucleotide"
guuugcaaacaaaaugauggu

SEQ ID NO: 751 - RNA, 21 nt, Artificial Sequence
  source: /note="Description of Artificial Sequence: Synthetic oligonucleotide"
uuugcaaacaaaaugauggga

SEQ ID NO: 752 - RNA, 21 nt, Artificial Sequence
  source: /note="Description of Artificial Sequence: Synthetic oligonucleotide"
gcauucagcaauuaaagacau

SEQ ID NO: 753 - RNA, 21 nt, Artificial Sequence
  source: /note="Description of Artificial Sequence: Synthetic oligonucleotide"
cauucagcaauuaaagacauu

SEQ ID NO: 754 - RNA, 21 nt, Artificial Sequence
  source: /note="Description of Artificial Sequence: Synthetic oligonucleotide"
uuugcagacuagcuaauuagu

SEQ ID NO: 755 - RNA, 21 nt, Artificial Sequence
  source: /note="Description of Artificial Sequence: Synthetic oligonucleotide"
uugcagacuagcuaauuagcu

SEQ ID NO: 756 - RNA, 21 nt, Artificial Sequence
  source: /note="Description of Artificial Sequence: Synthetic oligonucleotide"
ugcagacuagcuaauuagcuu

SEQ ID NO: 757 - RNA, 21 nt, Artificial Sequence
  source: /note="Description of Artificial Sequence: Synthetic oligonucleotide"
gcagacuagcuaauuagcucu

SEQ ID NO: 758 - RNA, 21 nt, Artificial Sequence
  source: /note="Description of Artificial Sequence: Synthetic oligonucleotide"
cagacuagcuaauuagcucuu

SEQ ID NO: 759 - RNA, 21 nt, Artificial Sequence
  source: /note="Description of Artificial Sequence: Synthetic oligonucleotide"
gauguugauaauaguaauggu

SEQ ID NO: 760 - RNA, 21 nt, Artificial Sequence
  source: /note="Description of Artificial Sequence: Synthetic oligonucleotide"
auguugauaauaguaaugguu

SEQ ID NO: 761 - RNA, 21 nt, Artificial Sequence
  source: /note="Description of Artificial Sequence: Synthetic oligonucleotide"
uguugauaauaguaaugguuu

SEQ ID NO: 762 - RNA, 21 nt, Artificial Sequence
  source: /note="Description of Artificial Sequence: Synthetic oligonucleotide"
guugauaauaguaaugguucu

SEQ ID NO: 763 - RNA, 21 nt, Artificial Sequence
  source: /note="Description of Artificial Sequence: Synthetic oligonucleotide"
uugauaauaguaaugguucua

SEQ ID NO: 764 - RNA, 21 nt, Artificial Sequence
  source: /note="Description of Artificial Sequence: Synthetic oligonucleotide"
ugauaauaguaaugguucuau

SEQ ID NO: 765 - RNA, 21 nt, Artificial Sequence
  source: /note="Description of Artificial Sequence: Synthetic oligonucleotide"
uuucugcuaccugguuuucau

SEQ ID NO: 766 - RNA, 21 nt, Artificial Sequence
  source: /note="Description of Artificial Sequence: Synthetic oligonucleotide"
uucugcuaccugguuuucauu

SEQ ID NO: 767 - RNA, 21 nt, Artificial Sequence
  source: /note="Description of Artificial Sequence: Synthetic oligonucleotide"
ucugcuaccugguuuucauua

SEQ ID NO: 768 - RNA, 21 nt, Artificial Sequence
  source: /note="Description of Artificial Sequence: Synthetic oligonucleotide"
gcuaccugguuuucauuauuu

SEQ ID NO: 769 - RNA, 21 nt, Artificial Sequence
  source: /note="Description of Artificial Sequence: Synthetic oligonucleotide"
accugguuuucauuauuuucu

SEQ ID NO: 770 - RNA, 21 nt, Artificial Sequence
  source: /note="Description of Artificial Sequence: Synthetic oligonucleotide"
ccugguuuucauuauuuuccu

SEQ ID NO: 771 - RNA, 21 nt, Artificial Sequence
  source: /note="Description of Artificial Sequence: Synthetic oligonucleotide"
cugguuuucauuauuuuccca

SEQ ID NO: 772 - RNA, 21 nt, Artificial Sequence
  source: /note="Description of Artificial Sequence: Synthetic oligonucleotide"
ugguuuucauuauuuucccau

SEQ ID NO: 773 - RNA, 21 nt, Artificial Sequence
  source: /note="Description of Artificial Sequence: Synthetic oligonucleotide"
gguuuucauuauuuucccaca

SEQ ID NO: 774 - RNA, 21 nt, Artificial Sequence
  source: /note="Description of Artificial Sequence: Synthetic oligonucleotide"
uuuucauuauuuucccacaau

SEQ ID NO: 775 - RNA, 21 nt, Artificial Sequence
  source: /note="Description of Artificial Sequence: Synthetic oligonucleotide"
uuucauuauuuucccacaauu

SEQ ID NO: 776 - RNA, 21 nt, Artificial Sequence
  source: /note="Description of Artificial Sequence: Synthetic oligonucleotide"
ucauuauuuucccacaauucu

SEQ ID NO: 777 - RNA, 21 nt, Artificial Sequence
  source: /note="Description of Artificial Sequence: Synthetic oligonucleotide"
auuauuuucccacaauucuuu

SEQ ID NO: 778 - RNA, 21 nt, Artificial Sequence
  source: /note="Description of Artificial Sequence: Synthetic oligonucleotide"
uuauuuucccacaauucuuuu

SEQ ID NO: 779 - RNA, 21 nt, Artificial Sequence
  source: /note="Description of Artificial Sequence: Synthetic oligonucleotide"
uauuuucccacaauucuuuug

SEQ ID NO: 780 - RNA, 21 nt, Artificial Sequence
  source: /note="Description of Artificial Sequence: Synthetic oligonucleotide"
auuuucccacaauucuuuuga

SEQ ID NO: 781 - RNA, 21 nt, Artificial Sequence
  source: /note="Description of Artificial Sequence: Synthetic oligonucleotide"
uuuucccacaauucuuuugaa

SEQ ID NO: 782 - RNA, 21 nt, Artificial Sequence
  source: /note="Description of Artificial Sequence: Synthetic oligonucleotide"
uuucccacaauucuuuugaaa

SEQ ID NO: 783 - RNA, 21 nt, Artificial Sequence
  source: /note="Description of Artificial Sequence: Synthetic oligonucleotide"
uucccacaauucuuuugaaau

SEQ ID NO: 784 - RNA, 21 nt, Artificial Sequence
  source: /note="Description of Artificial Sequence: Synthetic oligonucleotide"
ucccacaauucuuuugaaaga

SEQ ID NO: 785 - RNA, 21 nt, Artificial Sequence
  source: /note="Description of Artificial Sequence: Synthetic oligonucleotide"
ccacaauucuuuugaaagauu

SEQ ID NO: 786 - RNA, 21 nt, Artificial Sequence
  source: /note="Description of Artificial Sequence: Synthetic oligonucleotide"
cuuuugaaagaugguaaucuu

SEQ ID NO: 787 - RNA, 21 nt, Artificial Sequence
  source: /note="Description of Artificial Sequence: Synthetic oligonucleotide"
uuuugaaagaugguaaucuuu

SEQ ID NO: 788 - RNA, 21 nt, Artificial Sequence
  source: /note="Description of Artificial Sequence: Synthetic oligonucleotide"
uuugaaagaugguaaucuuuu

SEQ ID NO: 789 - RNA, 21 nt, Artificial Sequence
  source: /note="Description of Artificial Sequence: Synthetic oligonucleotide"
uugaaagaugguaaucuuuuc

SEQ ID NO: 790 - RNA, 21 nt, Artificial Sequence
  source: /note="Description of Artificial Sequence: Synthetic oligonucleotide"
ugaaagaugguaaucuuuucu

SEQ ID NO: 791 - RNA, 21 nt, Artificial Sequence
  source: /note="Description of Artificial Sequence: Synthetic oligonucleotide"
gaaagaugguaaucuuuucuu

SEQ ID NO: 792 - RNA, 21 nt, Artificial Sequence
  source: /note="Description of Artificial Sequence: Synthetic oligonucleotide"
aaagaugguaaucuuuucuga

SEQ ID NO: 793 - RNA, 21 nt, Artificial Sequence
  source: /note="Description of Artificial Sequence: Synthetic oligonucleotide"
gacuggugcguuccuaaacuu

SEQ ID NO: 794 - RNA, 21 nt, Artificial Sequence
  source: /note="Description of Artificial Sequence: Synthetic oligonucleotide"
cuggugcguuccuaaacucuu

SEQ ID NO: 795 - RNA, 21 nt, Artificial Sequence
  source: /note="Description of Artificial Sequence: Synthetic oligonucleotide"
uggugcguuccuaaacucuga

SEQ ID NO: 796 - RNA, 21 nt, Artificial Sequence
  source: /note="Description of Artificial Sequence: Synthetic oligonucleotide"
ggugcguuccuaaacucugaa

SEQ ID NO: 797 - RNA, 21 nt, Artificial Sequence
  source: /note="Description of Artificial Sequence: Synthetic oligonucleotide"
gugcguuccuaaacucugaaa

SEQ ID NO: 798 - RNA, 21 nt, Artificial Sequence
  source: /note="Description of Artificial Sequence: Synthetic oligonucleotide"
ugcguuccuaaacucugaaau

SEQ ID NO: 799 - RNA, 21 nt, Artificial Sequence
  source: /note="Description of Artificial Sequence: Synthetic oligonucleotide"
uuuaaaaugugugagcauguu

SEQ ID NO: 800 - RNA, 21 nt, Artificial Sequence
  source: /note="Description of Artificial Sequence: Synthetic oligonucleotide"
uuaaaaugugugagcaugugu

SEQ ID NO: 801 - RNA, 21 nt, Artificial Sequence
  source: /note="Description of Artificial Sequence: Synthetic oligonucleotide"
ugugagcaugugcuuucccau

SEQ ID NO: 802 - RNA, 21 nt, Artificial Sequence
  source: /note="Description of Artificial Sequence: Synthetic oligonucleotide"
gugagcaugugcuuucccaga

SEQ ID NO: 803 - RNA, 21 nt, Artificial Sequence
  source: /note="Description of Artificial Sequence: Synthetic oligonucleotide"
gagcaugugcuuucccagauu

SEQ ID NO: 804 - RNA, 21 nt, Artificial Sequence
  source: /note="Description of Artificial Sequence: Synthetic oligonucleotide"
agcaugugcuuucccagaugu

SEQ ID NO: 805 - RNA, 21 nt, Artificial Sequence
  source: /note="Description of Artificial Sequence: Synthetic oligonucleotide"
caugugcuuucccagaugcuu

SEQ ID NO: 806 - RNA, 21 nt, Artificial Sequence
  source: /note="Description of Artificial Sequence: Synthetic oligonucleotide"
augugcuuucccagaugcuuu

SEQ ID NO: 807 - RNA, 21 nt, Artificial Sequence
  source: /note="Description of Artificial Sequence: Synthetic oligonucleotide"
ugugcuuucccagaugcuuua

SEQ ID NO: 808 - RNA, 21 nt, Artificial Sequence
  source: /note="Description of Artificial Sequence: Synthetic oligonucleotide"
gcuuucccagaugcuuuauga

SEQ ID NO: 809 - RNA, 21 nt, Artificial Sequence
  source: /note="Description of Artificial Sequence: Synthetic oligonucleotide"
cuuucccagaugcuuuaugaa

SEQ ID NO: 810 - RNA, 21 nt, Artificial Sequence
  source: /note="Description of Artificial Sequence: Synthetic oligonucleotide"
uuucccagaugcuuuaugaau

SEQ ID NO: 811 - RNA, 21 nt, Artificial Sequence
  source: /note="Description of Artificial Sequence: Synthetic oligonucleotide"
uucccagaugcuuuaugaauu

SEQ ID NO: 812 - RNA, 21 nt, Artificial Sequence
  source: /note="Description of Artificial Sequence: Synthetic oligonucleotide"
uuucacuuauaucaaaaccuu

SEQ ID NO: 813 - RNA, 21 nt, Artificial Sequence
  source: /note="Description of Artificial Sequence: Synthetic oligonucleotide"
cacuuauaucaaaaccuuaca

SEQ ID NO: 814 - RNA, 21 nt, Artificial Sequence
  source: /note="Description of Artificial Sequence: Synthetic oligonucleotide"
cuuauaucaaaaccuuacagu

SEQ ID NO: 815 - RNA, 21 nt, Artificial Sequence
  source: /note="Description of Artificial Sequence: Synthetic oligonucleotide"
uuauaucaaaaccuuacagcu

SEQ ID NO: 816 - RNA, 21 nt, Artificial Sequence
  source: /note="Description of Artificial Sequence: Synthetic oligonucleotide"
auaucaaaaccuuacagcuuu

SEQ ID NO: 817 - RNA, 21 nt, Artificial Sequence
  source: /note="Description of Artificial Sequence: Synthetic oligonucleotide"
aucaaaaccuuacagcuuugu

SEQ ID NO: 818 - RNA, 21 nt, Artificial Sequence
  source: /note="Description of Artificial Sequence: Synthetic oligonucleotide"
ucaaaaccuuacagcuuuguu

SEQ ID NO: 819 - RNA, 21 nt, Artificial Sequence
  source: /note="Description of Artificial Sequence: Synthetic oligonucleotide"
caaaaccuuacagcuuuguuu

SEQ ID NO: 820 - RNA, 21 nt, Artificial Sequence
  source: /note="Description of Artificial Sequence: Synthetic oligonucleotide"
aaaaccuuacagcuuuguugu

SEQ ID NO: 821 - RNA, 21 nt, Artificial Sequence
  source: /note="Description of Artificial Sequence: Synthetic oligonucleotide"
aaaccuuacagcuuuguugca

SEQ ID NO: 822 - RNA, 21 nt, Artificial Sequence
  source: /note="Description of Artificial Sequence: Synthetic oligonucleotide"
aaccuuacagcuuuguugcaa

SEQ ID NO: 823 - RNA, 21 nt, Artificial Sequence
  source: /note="Description of Artificial Sequence: Synthetic oligonucleotide"
accuuacagcuuuguugcaau

SEQ ID NO: 824 - RNA, 21 nt, Artificial Sequence
  source: /note="Description of Artificial Sequence: Synthetic oligonucleotide"
ccuuacagcuuuguugcaacu

SEQ ID NO: 825 - RNA, 21 nt, Artificial Sequence
  source: /note="Description of Artificial Sequence: Synthetic oligonucleotide"
cuuacagcuuuguugcaaccu

SEQ ID NO: 826 - RNA, 21 nt, Artificial Sequence
  source: /note="Description of Artificial Sequence: Synthetic oligonucleotide"
cuucuuccugcgccuuauuuu

SEQ ID NO: 827 - RNA, 21 nt, Artificial Sequence
  source: /note="Description of Artificial Sequence: Synthetic oligonucleotide"
uucuuccugcgccuuauuuuu

SEQ ID NO: 828 - RNA, 21 nt, Artificial Sequence
  source: /note="Description of Artificial Sequence: Synthetic oligonucleotide"
ccuuucuucuccaauugagaa

SEQ ID NO: 829 - RNA, 21 nt, Artificial Sequence
  source: /note="Description of Artificial Sequence: Synthetic oligonucleotide"
cuuucuucuccaauugagaaa

SEQ ID NO: 830 - RNA, 21 nt, Artificial Sequence
  source: /note="Description of Artificial Sequence: Synthetic oligonucleotide"
uuucuucuccaauugagaaaa

SEQ ID NO: 831 - RNA, 21 nt, Artificial Sequence
  source: /note="Description of Artificial Sequence: Synthetic oligonucleotide"
uucuucuccaauugagaaaau

SEQ ID NO: 832 - RNA, 21 nt, Artificial Sequence
  source: /note="Description of Artificial Sequence: Synthetic oligonucleotide"
cagugguuuaacuugaauucu

SEQ ID NO: 833 - RNA, 21 nt, Artificial Sequence
  source: /note="Description of Artificial Sequence: Synthetic oligonucleotide"
agugguuuaacuugaauucuu

SEQ ID NO: 834 - RNA, 21 nt, Artificial Sequence
  source: /note="Description of Artificial Sequence: Synthetic oligonucleotide"
gaguccaucuuccacgagaaa

SEQ ID NO: 835 - RNA, 21 nt, Artificial Sequence
  source: /note="Description of Artificial Sequence: Synthetic oligonucleotide"
caacagaugcaucgaccaaaa

SEQ ID NO: 836 - RNA, 21 nt, Artificial Sequence
  source: /note="Description of Artificial Sequence: Synthetic oligonucleotide"
agaugcaucgaccaaaacuua

SEQ ID NO: 837 - RNA, 21 nt, Artificial Sequence
  source: /note="Description of Artificial Sequence: Synthetic oligonucleotide"
ucgaccaaaacuuauuggaga

SEQ ID NO: 838 - RNA, 21 nt, Artificial Sequence
  source: /note="Description of Artificial Sequence: Synthetic oligonucleotide"
guaugcaagguaguuccagaa

SEQ ID NO: 839 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uguuuatuugucuggagccaacg

SEQ ID NO: 840 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauguutauuugucuggagccaa

SEQ ID NO: 841 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaugutuauuugucuggagcca

SEQ ID NO: 842 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccaugtuuauuugucuggagcc

SEQ ID NO: 843 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuccatguuuauuugucuggag

SEQ ID NO: 844 - RNA, 23 nt, Artificial Sequence
  source: /note="Description of Artificial Sequence: Synthetic oligonucleotide"
aacuccauguuuauuugucugga

SEQ ID NO: 845 - RNA, 23 nt, Artificial Sequence
  source: /note="Description of Artificial Sequence: Synthetic oligonucleotide"
agacuccauguuuauuugucugg

SEQ ID NO: 846 - RNA, 23 nt, Artificial Sequence
  source: /note="Description of Artificial Sequence: Synthetic oligonucleotide"
uuucucguggaagauggacucca

SEQ ID NO: 847 - RNA, 23 nt, Artificial Sequence
  source: /note="Description of Artificial Sequence: Synthetic oligonucleotide"
uuguuucucguggaagauggacu

SEQ ID NO: 848 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuugutucucguggaagaugga

SEQ ID NO: 849 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucuugtuucucguggaagaugg

SEQ ID NO: 850 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuucutguuucucguggaagau

SEQ ID NO: 851 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
accuuctuguuucucguggaaga

SEQ ID NO: 852 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagccutcuuguuucucguggaa

SEQ ID NO: 853 - RNA, 23 nt, Artificial Sequence
  source: /note="Description of Artificial Sequence: Synthetic oligonucleotide"
uauuuccagaaggcugcuguaaa

SEQ ID NO: 854 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauauutccagaaggcugcugua

SEQ ID NO: 855 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acauautuccagaaggcugcugu

SEQ ID NO: 856 - RNA, 23 nt, Artificial Sequence
  source: /note="Description of Artificial Sequence: Synthetic oligonucleotide"
aauucaaguuaaaccacugaaua

SEQ ID NO: 857 - RNA, 23 nt, Artificial Sequence
  source: /note="Description of Artificial Sequence: Synthetic oligonucleotide"
aaauucaaguuaaaccacugaau

SEQ ID NO: 858 - RNA, 23 nt, Artificial Sequence
  source: /note="Description of Artificial Sequence: Synthetic oligonucleotide"
agaauucaaguuaaaccacugaa

SEQ ID NO: 859 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaautcaaguuaaaccacuga

SEQ ID NO: 860 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaauatagaauaaccuuccugu

SEQ ID NO: 861 - RNA, 23 nt, Artificial Sequence
  source: /note="Description of Artificial Sequence: Synthetic oligonucleotide"
acaaauauagaauaaccuuccug

SEQ ID NO: 862 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacaaatauagaauaaccuuccu

SEQ ID NO: 863 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auccaataaguuuuggucgaugc

SEQ ID NO: 864 - RNA, 23 nt, Artificial Sequence
  source: /note="Description of Artificial Sequence: Synthetic oligonucleotide"
ucuccaauaaguuuuggucgaug

SEQ ID NO: 865 - RNA, 23 nt, Artificial Sequence
  source: /note="Description of Artificial Sequence: Synthetic oligonucleotide"
uucuccaauaaguuuuggucgau

SEQ ID NO: 866 - RNA, 23 nt, Artificial Sequence
  source: /note="Description of Artificial Sequence: Synthetic oligonucleotide"
uuuucaaaguaggcuucucgucu

SEQ ID NO: 867 - RNA, 23 nt, Artificial Sequence
  source: /note="Description of Artificial Sequence: Synthetic oligonucleotide"
uuuuucaaaguaggcuucucguc

SEQ ID NO: 868 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucacctagaucacucccaagug

SEQ ID NO: 869 - RNA, 23 nt, Artificial Sequence
  source: /note="Description of Artificial Sequence: Synthetic oligonucleotide"
aaucaccuagaucacucccaagu

SEQ ID NO: 870 - RNA, 23 nt, Artificial Sequence
  source: /note="Description of Artificial Sequence: Synthetic oligonucleotide"
uagcaucaccuagaucacuccca

SEQ ID NO: 871 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auagcatcaccuagaucacuccc

SEQ ID NO: 872 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acaguutcuaaagacauggucac

SEQ ID NO: 873 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aacagutucuaaagacaugguca

SEQ ID NO: 874 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugacagtuucuaaagacaugguc

SEQ ID NO: 875 - RNA, 23 nt, Artificial Sequence
  source: /note="Description of Artificial Sequence: Synthetic oligonucleotide"
augacaguuucuaaagacauggu

SEQ ID NO: 876 - RNA, 23 nt, Artificial Sequence
  source: /note="Description of Artificial Sequence: Synthetic oligonucleotide"
uucugacaguuucuaaagacaug

SEQ ID NO: 877 - RNA, 23 nt, Artificial Sequence
  source: /note="Description of Artificial Sequence: Synthetic oligonucleotide"
uuucugacaguuucuaaagacau

SEQ ID NO: 878 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuguutucaaaucauuucugac

SEQ ID NO: 879 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uccuuctguuuucaaaucauuuc

SEQ ID NO: 880 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuguutgcaaaccgcuaaaagu

SEQ ID NO: 881 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuugutugcaaaccgcuaaaag

SEQ ID NO: 882 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuugtuugcaaaccgcuaaaa

SEQ ID NO: 883 - RNA, 23 nt, Artificial Sequence
  source: /note="Description of Artificial Sequence: Synthetic oligonucleotide"
aauuuuguuugcaaaccgcuaaa

SEQ ID NO: 884 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucauuutguuugcaaaccgcuaa

SEQ ID NO: 885 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aucauutuguuugcaaaccgcua

SEQ ID NO: 886 - RNA, 23 nt, Artificial Sequence
  source: /note="Description of Artificial Sequence: Synthetic oligonucleotide"
accaucauuuuguuugcaaaccg

SEQ ID NO: 887 - RNA, 23 nt, Artificial Sequence
  source: /note="Description of Artificial Sequence: Synthetic oligonucleotide"
ucccaucauuuuguuugcaaacc

SEQ ID NO: 888 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
augucutuaauugcugaaugccu

SEQ ID NO: 889 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauguctuuaauugcugaaugcc

SEQ ID NO: 890 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
acuaautagcuagucugcaaaaa

SEQ ID NO: 891 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agcuaatuagcuagucugcaaaa

SEQ ID NO: 892 - RNA, 23 nt, Artificial Sequence
  source: /note="Description of Artificial Sequence: Synthetic oligonucleotide"
aagcuaauuagcuagucugcaaa

SEQ ID NO: 893 - RNA, 23 nt, Artificial Sequence
  source: /note="Description of Artificial Sequence: Synthetic oligonucleotide"
agagcuaauuagcuagucugcaa

SEQ ID NO: 894 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagagctaauuagcuagucugca

SEQ ID NO: 895 - RNA, 23 nt, Artificial Sequence
  source: /note="Description of Artificial Sequence: Synthetic oligonucleotide"
accauuacuauuaucaacaucag

SEQ ID NO: 896 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaccautacuauuaucaacauca

SEQ ID NO: 897 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaccatuacuauuaucaacauc

SEQ ID NO: 898 - RNA, 23 nt, Artificial Sequence
  source: /note="Description of Artificial Sequence: Synthetic oligonucleotide"
agaaccauuacuauuaucaacau

SEQ ID NO: 899 - RNA, 23 nt, Artificial Sequence
  source: /note="Description of Artificial Sequence: Synthetic oligonucleotide"
uagaaccauuacuauuaucaaca

SEQ ID NO: 900 - RNA, 23 nt, Artificial Sequence
  source: /note="Description of Artificial Sequence: Synthetic oligonucleotide"
auagaaccauuacuauuaucaac

SEQ ID NO: 901 - RNA, 23 nt, Artificial Sequence
  source: /note="Description of Artificial Sequence: Synthetic oligonucleotide"
augaaaaccagguagcagaaaag

SEQ ID NO: 902 - RNA, 23 nt, Artificial Sequence
  source: /note="Description of Artificial Sequence: Synthetic oligonucleotide"
aaugaaaaccagguagcagaaaa

SEQ ID NO: 903 - RNA, 23 nt, Artificial Sequence
  source: /note="Description of Artificial Sequence: Synthetic oligonucleotide"
uaaugaaaaccagguagcagaaa

SEQ ID NO: 904 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauaatgaaaaccagguagcag

SEQ ID NO: 905 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
agaaaataaugaaaaccagguag

SEQ ID NO: 906 - RNA, 23 nt, Artificial Sequence
  source: /note="Description of Artificial Sequence: Synthetic oligonucleotide"
aggaaaauaaugaaaaccaggua

SEQ ID NO: 907 - RNA, 23 nt, Artificial Sequence
  source: /note="Description of Artificial Sequence: Synthetic oligonucleotide"
ugggaaaauaaugaaaaccaggu

SEQ ID NO: 908 - RNA, 23 nt, Artificial Sequence
  source: /note="Description of Artificial Sequence: Synthetic oligonucleotide"
augggaaaauaaugaaaaccagg

SEQ ID NO: 909 - RNA, 23 nt, Artificial Sequence
  source: /note="Description of Artificial Sequence: Synthetic oligonucleotide"
ugugggaaaauaaugaaaaccag

SEQ ID NO: 910 - RNA, 23 nt, Artificial Sequence
  source: /note="Description of Artificial Sequence: Synthetic oligonucleotide"
auugugggaaaauaaugaaaacc

SEQ ID NO: 911 - RNA, 23 nt, Artificial Sequence
  source: /note="Description of Artificial Sequence: Synthetic oligonucleotide"
aauugugggaaaauaaugaaaac

SEQ ID NO: 912 - RNA, 23 nt, Artificial Sequence
  source: /note="Description of Artificial Sequence: Synthetic oligonucleotide"
agaauugugggaaaauaaugaaa

SEQ ID NO: 913 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagaatugugggaaaauaauga

SEQ ID NO: 914 - RNA, 23 nt, Artificial Sequence
  source: /note="Description of Artificial Sequence: Synthetic oligonucleotide"
aaaagaauugugggaaaauaaug

SEQ ID NO: 915 - RNA, 23 nt, Artificial Sequence
  source: /note="Description of Artificial Sequence: Synthetic oligonucleotide"
caaaagaauugugggaaaauaau

SEQ ID NO: 916 - RNA, 23 nt, Artificial Sequence
  source: /note="Description of Artificial Sequence: Synthetic oligonucleotide"
ucaaaagaauugugggaaaauaa

SEQ ID NO: 917 - RNA, 23 nt, Artificial Sequence
  source: /note="Description of Artificial Sequence: Synthetic oligonucleotide"
uucaaaagaauugugggaaaaua

SEQ ID NO: 918 - RNA, 23 nt, Artificial Sequence
  source: /note="Description of Artificial Sequence: Synthetic oligonucleotide"
uuucaaaagaauugugggaaaau

SEQ ID NO: 919 - RNA, 23 nt, Artificial Sequence
  source: /note="Description of Artificial Sequence: Synthetic oligonucleotide"
auuucaaaagaauugugggaaaa

SEQ ID NO: 920 - RNA, 23 nt, Artificial Sequence
  source: /note="Description of Artificial Sequence: Synthetic oligonucleotide"
ucuuucaaaagaauugugggaaa

SEQ ID NO: 921 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaucuutcaaaagaauuguggga

SEQ ID NO: 922 - RNA, 23 nt, Artificial Sequence
  source: /note="Description of Artificial Sequence: Synthetic oligonucleotide"
aagauuaccaucuuucaaaagaa

SEQ ID NO: 923 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagautaccaucuuucaaaaga

SEQ ID NO: 924 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaaagatuaccaucuuucaaaag

SEQ ID NO: 925 - RNA, 23 nt, Artificial Sequence
  source: /note="Description of Artificial Sequence: Synthetic oligonucleotide"
gaaaagauuaccaucuuucaaaa

SEQ ID NO: 926 - RNA, 23 nt, Artificial Sequence
  source: /note="Description of Artificial Sequence: Synthetic oligonucleotide"
agaaaagauuaccaucuuucaaa

SEQ ID NO: 927 - RNA, 23 nt, Artificial Sequence
  source: /note="Description of Artificial Sequence: Synthetic oligonucleotide"
aagaaaagauuaccaucuuucaa

SEQ ID NO: 928 - RNA, 23 nt, Artificial Sequence
  source: /note="Description of Artificial Sequence: Synthetic oligonucleotide"
ucagaaaagauuaccaucuuuca

SEQ ID NO: 929 - RNA, 23 nt, Artificial Sequence
  source: /note="Description of Artificial Sequence: Synthetic oligonucleotide"
aaguuuaggaacgcaccagucau

SEQ ID NO: 930 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagagutuaggaacgcaccaguc

SEQ ID NO: 931 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucagagtuuaggaacgcaccagu

SEQ ID NO: 932 - RNA, 23 nt, Artificial Sequence
  source: /note="Description of Artificial Sequence: Synthetic oligonucleotide"
uucagaguuuaggaacgcaccag

SEQ ID NO: 933 - RNA, 23 nt, Artificial Sequence
  source: /note="Description of Artificial Sequence: Synthetic oligonucleotide"
uuucagaguuuaggaacgcacca

SEQ ID NO: 934 - RNA, 23 nt, Artificial Sequence
  source: /note="Description of Artificial Sequence: Synthetic oligonucleotide"
auuucagaguuuaggaacgcacc

SEQ ID NO: 935 - RNA, 23 nt, Artificial Sequence
  source: /note="Description of Artificial Sequence: Synthetic oligonucleotide"
aacaugcucacacauuuuaaaaa

SEQ ID NO: 936 - RNA, 23 nt, Artificial Sequence
  source: /note="Description of Artificial Sequence: Synthetic oligonucleotide"
acacaugcucacacauuuuaaaa

SEQ ID NO: 937 - RNA, 23 nt, Artificial Sequence
  source: /note="Description of Artificial Sequence: Synthetic oligonucleotide"
augggaaagcacaugcucacaca

SEQ ID NO: 938 - RNA, 23 nt, Artificial Sequence
  source: /note="Description of Artificial Sequence: Synthetic oligonucleotide"
ucugggaaagcacaugcucacac

SEQ ID NO: 939 - RNA, 23 nt, Artificial Sequence
  source: /note="Description of Artificial Sequence: Synthetic oligonucleotide"
aaucugggaaagcacaugcucac

SEQ ID NO: 940 - RNA, 23 nt, Artificial Sequence
  source: /note="Description of Artificial Sequence: Synthetic oligonucleotide"
acaucugggaaagcacaugcuca

SEQ ID NO: 941 - RNA, 23 nt, Artificial Sequence
  source: /note="Description of Artificial Sequence: Synthetic oligonucleotide"
aagcaucugggaaagcacaugcu

SEQ ID NO: 942 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaagcatcugggaaagcacaugc

SEQ ID NO: 943 - RNA, 23 nt, Artificial Sequence
  source: /note="Description of Artificial Sequence: Synthetic oligonucleotide"
uaaagcaucugggaaagcacaug

SEQ ID NO: 944 - RNA, 23 nt, Artificial Sequence
  source: /note="Description of Artificial Sequence: Synthetic oligonucleotide"
ucauaaagcaucugggaaagcac

SEQ ID NO: 945 - RNA, 23 nt, Artificial Sequence
  source: /note="Description of Artificial Sequence: Synthetic oligonucleotide"
uucauaaagcaucugggaaagca

SEQ ID NO: 946 - RNA, 23 nt, Artificial Sequence
  source: /note="Description of Artificial Sequence: Synthetic oligonucleotide"
auucauaaagcaucugggaaagc

SEQ ID NO: 947 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauucataaagcaucugggaaag

SEQ ID NO: 948 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagguutugauauaagugaaaag

SEQ ID NO: 949 - RNA, 23 nt, Artificial Sequence
  source: /note="Description of Artificial Sequence: Synthetic oligonucleotide"
uguaagguuuugauauaagugaa

SEQ ID NO: 950 - RNA, 23 nt, Artificial Sequence
  source: /note="Description of Artificial Sequence: Synthetic oligonucleotide"
acuguaagguuuugauauaagug

SEQ ID NO: 951 - RNA, 23 nt, Artificial Sequence
  source: /note="Description of Artificial Sequence: Synthetic oligonucleotide"
agcuguaagguuuugauauaagu

SEQ ID NO: 952 - RNA, 23 nt, Artificial Sequence
  source: /note="Description of Artificial Sequence: Synthetic oligonucleotide"
aaagcuguaagguuuugauauaa

SEQ ID NO: 953 - RNA, 23 nt, Artificial Sequence
  source: /note="Description of Artificial Sequence: Synthetic oligonucleotide"
acaaagcuguaagguuuugauau

SEQ ID NO: 954 - RNA, 23 nt, Artificial Sequence
  source: /note="Description of Artificial Sequence: Synthetic oligonucleotide"
aacaaagcuguaagguuuugaua

SEQ ID NO: 955 - RNA, 23 nt, Artificial Sequence
  source: /note="Description of Artificial Sequence: Synthetic oligonucleotide"
aaacaaagcuguaagguuuugau

SEQ ID NO: 956 - RNA, 23 nt, Artificial Sequence
  source: /note="Description of Artificial Sequence: Synthetic oligonucleotide"
acaacaaagcuguaagguuuuga

SEQ ID NO: 957 - RNA, 23 nt, Artificial Sequence
  source: /note="Description of Artificial Sequence: Synthetic oligonucleotide"
ugcaacaaagcuguaagguuuug

SEQ ID NO: 958 - RNA, 23 nt, Artificial Sequence
  source: /note="Description of Artificial Sequence: Synthetic oligonucleotide"
uugcaacaaagcuguaagguuuu

SEQ ID NO: 959 - RNA, 23 nt, Artificial Sequence
  source: /note="Description of Artificial Sequence: Synthetic oligonucleotide"
auugcaacaaagcuguaagguuu

SEQ ID NO: 960 - RNA, 23 nt, Artificial Sequence
  source: /note="Description of Artificial Sequence: Synthetic oligonucleotide"
aguugcaacaaagcuguaagguu

SEQ ID NO: 961 - RNA, 23 nt, Artificial Sequence
  source: /note="Description of Artificial Sequence: Synthetic oligonucleotide"
agguugcaacaaagcuguaaggu

SEQ ID NO: 962 - RNA, 23 nt, Artificial Sequence
  source: /note="Description of Artificial Sequence: Synthetic oligonucleotide"
aaaauaaggcgcaggaagaaggg

SEQ ID NO: 963 - RNA, 23 nt, Artificial Sequence
  source: /note="Description of Artificial Sequence: Synthetic oligonucleotide"
aaaaauaaggcgcaggaagaagg

SEQ ID NO: 964 - RNA, 23 nt, Artificial Sequence
  source: /note="Description of Artificial Sequence: Synthetic oligonucleotide"
uucucaauuggagaagaaaggaa

SEQ ID NO: 965 - RNA, 23 nt, Artificial Sequence
  source: /note="Description of Artificial Sequence: Synthetic oligonucleotide"
uuucucaauuggagaagaaagga

SEQ ID NO: 966 - RNA, 23 nt, Artificial Sequence
  source: /note="Description of Artificial Sequence: Synthetic oligonucleotide"
uuuucucaauuggagaagaaagg

SEQ ID NO: 967 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
auuuuctcaauuggagaagaaag

SEQ ID NO: 968 - RNA, 23 nt, Artificial Sequence
  source: /note="Description of Artificial Sequence: Synthetic oligonucleotide"
agaauucaaguuaaaccacugcu

SEQ ID NO: 969 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aagaautcaaguuaaaccacugc

SEQ ID NO: 970 - RNA, 23 nt, Artificial Sequence
  source: /note="Description of Artificial Sequence: Synthetic oligonucleotide"
uuucucguggaagauggacucca

SEQ ID NO: 971 - RNA, 23 nt, Artificial Sequence
  source: /note="Description of Artificial Sequence: Synthetic oligonucleotide"
uuuuggucgaugcaucuguugga

SEQ ID NO: 972 - RNA, 23 nt, Artificial Sequence
  source: /note="Description of Artificial Sequence: Synthetic oligonucleotide"
uaaguuuuggucgaugcaucugu

SEQ ID NO: 973 - RNA, 23 nt, Artificial Sequence
  source: /note="Description of Artificial Sequence: Synthetic oligonucleotide"
ucuccaauaaguuuuggucgaug

SEQ ID NO: 974 - RNA, 23 nt, Artificial Sequence
  source: /note="Description of Artificial Sequence: Synthetic oligonucleotide"
uucuggaacuaccuugcauacug

SEQ ID NO: 975 - RNA, 21 nt, Artificial Sequence
  source: /note="Description of Artificial Sequence: Synthetic oligonucleotide"
agcagugguuuaacuugaauu

SEQ ID NO: 976 - RNA, 21 nt, Artificial Sequence
  source: /note="Description of Artificial Sequence: Synthetic oligonucleotide"
gcagugguuuaacuugaauuu

SEQ ID NO: 977 - RNA, 21 nt, Artificial Sequence
  source: /note="Description of Artificial Sequence: Synthetic oligonucleotide"
aagaagguuauucuauauuug

SEQ ID NO: 978 - RNA, 21 nt, Artificial Sequence
  source: /note="Description of Artificial Sequence: Synthetic oligonucleotide"
agaagguuauucuauauuugu

SEQ ID NO: 979 - RNA, 21 nt, Artificial Sequence
  source: /note="Description of Artificial Sequence: Synthetic oligonucleotide"
cgaccaaaacuuauuggagau

SEQ ID NO: 980 - RNA, 21 nt, Artificial Sequence
  source: /note="Description of Artificial Sequence: Synthetic oligonucleotide"
cgagaagccuacuuugaaaau

SEQ ID NO: 981 - RNA, 21 nt, Artificial Sequence
  source: /note="Description of Artificial Sequence: Synthetic oligonucleotide"
ggcuccagacaaauaaacaua

SEQ ID NO: 982 - RNA, 21 nt, Artificial Sequence
  source: /note="Description of Artificial Sequence: Synthetic oligonucleotide"
aauaaacauggaguccaucua

SEQ ID NO: 983 - RNA, 21 nt, Artificial Sequence
  source: /note="Description of Artificial Sequence: Synthetic oligonucleotide"
aguccaucuuccacgagaaaa

SEQ ID NO: 984 - RNA, 21 nt, Artificial Sequence
  source: /note="Description of Artificial Sequence: Synthetic oligonucleotide"
ugcaaggagaguauuuuagca

SEQ ID NO: 985 - RNA, 21 nt, Artificial Sequence
  source: /note="Description of Artificial Sequence: Synthetic oligonucleotide"
gcaaggagaguauuuuagcca

SEQ ID NO: 986 - RNA, 21 nt, Artificial Sequence
  source: /note="Description of Artificial Sequence: Synthetic oligonucleotide"
gaagacuaccgcacauuuuua

SEQ ID NO: 987 - RNA, 21 nt, Artificial Sequence
  source: /note="Description of Artificial Sequence: Synthetic oligonucleotide"
agacuaccgcacauuuuuaca

SEQ ID NO: 988 - RNA, 21 nt, Artificial Sequence
  source: /note="Description of Artificial Sequence: Synthetic oligonucleotide"
cuaccgcacauuuuuacagca

SEQ ID NO: 989 - RNA, 21 nt, Artificial Sequence
  source: /note="Description of Artificial Sequence: Synthetic oligonucleotide"
gugaagacuaccgcacauuua

SEQ ID NO: 990 - RNA, 21 nt, Artificial Sequence
  source: /note="Description of Artificial Sequence: Synthetic oligonucleotide"
ugaagacuaccgcacauuuua

SEQ ID NO: 991 - RNA, 21 nt, Artificial Sequence
  source: /note="Description of Artificial Sequence: Synthetic oligonucleotide"
aagacuaccgcacauuuuuaa

SEQ ID NO: 992 - RNA, 21 nt, Artificial Sequence
  source: /note="Description of Artificial Sequence: Synthetic oligonucleotide"
acuaccgcacauuuuuacaga

SEQ ID NO: 993 - RNA, 21 nt, Artificial Sequence
  source: /note="Description of Artificial Sequence: Synthetic oligonucleotide"
uaccgcacauuuuuacagcaa

SEQ ID NO: 994 - RNA, 21 nt, Artificial Sequence
  source: /note="Description of Artificial Sequence: Synthetic oligonucleotide"
ccgcacauuuuuacagcagca

SEQ ID NO: 995 - RNA, 21 nt, Artificial Sequence
  source: /note="Description of Artificial Sequence: Synthetic oligonucleotide"
cagcagccuucuggaaauaua

SEQ ID NO: 996 - RNA, 21 nt, Artificial Sequence
  source: /note="Description of Artificial Sequence: Synthetic oligonucleotide"
cagcggcuuuuucucuauuca

SEQ ID NO: 997 - RNA, 21 nt, Artificial Sequence
  source: /note="Description of Artificial Sequence: Synthetic oligonucleotide"
ucucuauucaaguuauaagca

SEQ ID NO: 998 - RNA, 21 nt, Artificial Sequence
  source: /note="Description of Artificial Sequence: Synthetic oligonucleotide"
cucuauucaaguuauaagcaa

SEQ ID NO: 999 - RNA, 21 nt, Artificial Sequence
  source: /note="Description of Artificial Sequence: Synthetic oligonucleotide"
ugacagcggcuuuuucucuaa

SEQ ID NO: 1000 - RNA, 21 nt, Artificial Sequence
  source: /note="Description of Artificial Sequence: Synthetic oligonucleotide"
gcggcuuuuucucuauucaaa

SEQ ID NO: 1001 - RNA, 21 nt, Artificial Sequence
  source: /note="Description of Artificial Sequence: Synthetic oligonucleotide"
uauucaaguuauaagcaauga

SEQ ID NO: 1002 - RNA, 21 nt, Artificial Sequence
  source: /note="Description of Artificial Sequence: Synthetic oligonucleotide"
aagauccuuuauaugcaauua

SEQ ID NO: 1003 - RNA, 21 nt, Artificial Sequence
  source: /note="Description of Artificial Sequence: Synthetic oligonucleotide"
aacacugguuuacaguuagaa

SEQ ID NO: 1004 - RNA, 21 nt, Artificial Sequence
  source: /note="Description of Artificial Sequence: Synthetic oligonucleotide"
acacugguuuacaguuagaaa

SEQ ID NO: 1005 - RNA, 21 nt, Artificial Sequence
  source: /note="Description of Artificial Sequence: Synthetic oligonucleotide"
aaagauccuuuauaugcaaua

SEQ ID NO: 1006 - RNA, 21 nt, Artificial Sequence
  source: /note="Description of Artificial Sequence: Synthetic oligonucleotide"
caauuauaaagaacacuggua

SEQ ID NO: 1007 - RNA, 21 nt, Artificial Sequence
  source: /note="Description of Artificial Sequence: Synthetic oligonucleotide"
aaagaacacugguuuacagua

SEQ ID NO: 1008 - RNA, 21 nt, Artificial Sequence
  source: /note="Description of Artificial Sequence: Synthetic oligonucleotide"
agaacacugguuuacaguuaa

SEQ ID NO: 1009 - RNA, 21 nt, Artificial Sequence
  source: /note="Description of Artificial Sequence: Synthetic oligonucleotide"
agcagugguuuaacuugaaua

SEQ ID NO: 1010 - RNA, 21 nt, Artificial Sequence
  source: /note="Description of Artificial Sequence: Synthetic oligonucleotide"
uacagcaagaagguuauucua

SEQ ID NO: 1011 - RNA, 21 nt, Artificial Sequence
  source: /note="Description of Artificial Sequence: Synthetic oligonucleotide"
aauuacagcaagaagguuaua

SEQ ID NO: 1012 - RNA, 21 nt, Artificial Sequence
  source: /note="Description of Artificial Sequence: Synthetic oligonucleotide"
auuacagcaagaagguuauua

SEQ ID NO: 1013 - RNA, 21 nt, Artificial Sequence
  source: /note="Description of Artificial Sequence: Synthetic oligonucleotide"
acagcaagaagguuauucuaa

SEQ ID NO: 1014 - RNA, 21 nt, Artificial Sequence
  source: /note="Description of Artificial Sequence: Synthetic oligonucleotide"
agcaagaagguuauucuauaa

SEQ ID NO: 1015 - RNA, 21 nt, Artificial Sequence
  source: /note="Description of Artificial Sequence: Synthetic oligonucleotide"
gcaagaagguuauucuauaua

SEQ ID NO: 1016 - RNA, 21 nt, Artificial Sequence
  source: /note="Description of Artificial Sequence: Synthetic oligonucleotide"
caagaagguuauucuauauua

SEQ ID NO: 1017 - RNA, 21 nt, Artificial Sequence
  source: /note="Description of Artificial Sequence: Synthetic oligonucleotide"
aagggugaucugccagauuga

SEQ ID NO: 1018 - RNA, 21 nt, Artificial Sequence
  source: /note="Description of Artificial Sequence: Synthetic oligonucleotide"
uugugaagcugaccaacuuua

SEQ ID NO: 1019 - RNA, 21 nt, Artificial Sequence
  source: /note="Description of Artificial Sequence: Synthetic oligonucleotide"
ugugaagcugaccaacuuuua

SEQ ID NO: 1020 - RNA, 21 nt, Artificial Sequence
  source: /note="Description of Artificial Sequence: Synthetic oligonucleotide"
cagaugaucaagguccaacaa

SEQ ID NO: 1021 - RNA, 21 nt, Artificial Sequence
  source: /note="Description of Artificial Sequence: Synthetic oligonucleotide"
gaugaucaagguccaacagaa

SEQ ID NO: 1022 - RNA, 21 nt, Artificial Sequence
  source: /note="Description of Artificial Sequence: Synthetic oligonucleotide"
augaucaagguccaacagaua

SEQ ID NO: 1023 - RNA, 21 nt, Artificial Sequence
  source: /note="Description of Artificial Sequence: Synthetic oligonucleotide"
acagaugcaucgaccaaaaca

SEQ ID NO: 1024 - RNA, 21 nt, Artificial Sequence
  source: /note="Description of Artificial Sequence: Synthetic oligonucleotide"
cagaugcaucgaccaaaacua

SEQ ID NO: 1025 - RNA, 21 nt, Artificial Sequence
  source: /note="Description of Artificial Sequence: Synthetic oligonucleotide"
gaugcaucgaccaaaacuuaa

SEQ ID NO: 1026 - RNA, 21 nt, Artificial Sequence
  source: /note="Description of Artificial Sequence: Synthetic oligonucleotide"
augcaucgaccaaaacuuaua

SEQ ID NO: 1027 - RNA, 21 nt, Artificial Sequence
  source: /note="Description of Artificial Sequence: Synthetic oligonucleotide"
aucgaccaaaacuuauuggaa

SEQ ID NO: 1028 - RNA, 21 nt, Artificial Sequence
  source: /note="Description of Artificial Sequence: Synthetic oligonucleotide"
ucagcucaguaugcaagguaa

SEQ ID NO: 1029 - RNA, 21 nt, Artificial Sequence
  source: /note="Description of Artificial Sequence: Synthetic oligonucleotide"
cagcucaguaugcaagguaga

SEQ ID NO: 1030 - RNA, 21 nt, Artificial Sequence
  source: /note="Description of Artificial Sequence: Synthetic oligonucleotide"
gcucaguaugcaagguaguua

SEQ ID NO: 1031 - RNA, 21 nt, Artificial Sequence
  source: /note="Description of Artificial Sequence: Synthetic oligonucleotide"
cuacuuugaaaagcaacagca

SEQ ID NO: 1032 - RNA, 21 nt, Artificial Sequence
  source: /note="Description of Artificial Sequence: Synthetic oligonucleotide"
agugguuuguaagcagaaaga

SEQ ID NO: 1033 - RNA, 21 nt, Artificial Sequence
  source: /note="Description of Artificial Sequence: Synthetic oligonucleotide"
aagaggcagucagcaaugaaa

SEQ ID NO: 1034 - RNA, 21 nt, Artificial Sequence
  source: /note="Description of Artificial Sequence: Synthetic oligonucleotide"
aaaugugcaauaucugacuga

SEQ ID NO: 1035 - RNA, 21 nt, Artificial Sequence
  source: /note="Description of Artificial Sequence: Synthetic oligonucleotide"
aaugugcaauaucugacugaa

SEQ ID NO: 1036 - RNA, 21 nt, Artificial Sequence
  source: /note="Description of Artificial Sequence: Synthetic oligonucleotide"
auaucugacugaaauuaugga

SEQ ID NO: 1037 - RNA, 21 nt, Artificial Sequence
  source: /note="Description of Artificial Sequence: Synthetic oligonucleotide"
uucaaaugugcaauaucugaa

SEQ ID NO: 1038 - RNA, 21 nt, Artificial Sequence
  source: /note="Description of Artificial Sequence: Synthetic oligonucleotide"
ucaaaugugcaauaucugaca

SEQ ID NO: 1039 - RNA, 21 nt, Artificial Sequence
  source: /note="Description of Artificial Sequence: Synthetic oligonucleotide"
aauaucugacugaaauuauga

SEQ ID NO: 1040 - RNA, 21 nt, Artificial Sequence
  source: /note="Description of Artificial Sequence: Synthetic oligonucleotide"
agcucuugccacagaacuuga

SEQ ID NO: 1041 - RNA, 21 nt, Artificial Sequence
  source: /note="Description of Artificial Sequence: Synthetic oligonucleotide"
gcucuugccacagaacuugaa

SEQ ID NO: 1042 - RNA, 21 nt, Artificial Sequence
  source: /note="Description of Artificial Sequence: Synthetic oligonucleotide"
cuaguagaaaauaggcugcua

SEQ ID NO: 1043 - RNA, 21 nt, Artificial Sequence
  source: /note="Description of Artificial Sequence: Synthetic oligonucleotide"
gaaaauaggcugcuaggauga

SEQ ID NO: 1044 - RNA, 21 nt, Artificial Sequence
  source: /note="Description of Artificial Sequence: Synthetic oligonucleotide"
uaguagaaaauaggcugcuaa

SEQ ID NO: 1045 - RNA, 21 nt, Artificial Sequence
  source: /note="Description of Artificial Sequence: Synthetic oligonucleotide"
agaaaauaggcugcuaggaua

SEQ ID NO: 1046 - RNA, 21 nt, Artificial Sequence
  source: /note="Description of Artificial Sequence: Synthetic oligonucleotide"
guaugauuuggguggaaauua

SEQ ID NO: 1047 - RNA, 21 nt, Artificial Sequence
  source: /note="Description of Artificial Sequence: Synthetic oligonucleotide"
gguaugauuuggguggaaaua

SEQ ID NO: 1048 - RNA, 21 nt, Artificial Sequence
  source: /note="Description of Artificial Sequence: Synthetic oligonucleotide"
ugcacacguuuuuaucaggga

SEQ ID NO: 1049 - RNA, 21 nt, Artificial Sequence
  source: /note="Description of Artificial Sequence: Synthetic oligonucleotide"
gcacacguuuuuaucagggaa

SEQ ID NO: 1050 - RNA, 21 nt, Artificial Sequence
  source: /note="Description of Artificial Sequence: Synthetic oligonucleotide"
cacacguuuuuaucagggaaa

SEQ ID NO: 1051 - RNA, 21 nt, Artificial Sequence
  source: /note="Description of Artificial Sequence: Synthetic oligonucleotide"
uuuuuaucagggaaaguuuua

SEQ ID NO: 1052 - RNA, 21 nt, Artificial Sequence
  source: /note="Description of Artificial Sequence: Synthetic oligonucleotide"
uggauguaggauuuauugcua

SEQ ID NO: 1053 - RNA, 21 nt, Artificial Sequence
  source: /note="Description of Artificial Sequence: Synthetic oligonucleotide"
aguaauugcaaagguucagaa

SEQ ID NO: 1054 - RNA, 21 nt, Artificial Sequence
  source: /note="Description of Artificial Sequence: Synthetic oligonucleotide"
augaaaagaugccaaugcuua

SEQ ID NO: 1055 - RNA, 21 nt, Artificial Sequence
  source: /note="Description of Artificial Sequence: Synthetic oligonucleotide"
guaugaaaagaugccaaugca

SEQ ID NO: 1056 - RNA, 21 nt, Artificial Sequence
  source: /note="Description of Artificial Sequence: Synthetic oligonucleotide"
gccacaguauccaaaguguaa

SEQ ID NO: 1057 - RNA, 21 nt, Artificial Sequence
  source: /note="Description of Artificial Sequence: Synthetic oligonucleotide"
uuucuugaugaagccaaagua

SEQ ID NO: 1058 - RNA, 21 nt, Artificial Sequence
  source: /note="Description of Artificial Sequence: Synthetic oligonucleotide"
augaagccaaaguuaaugaga

SEQ ID NO: 1059 - RNA, 21 nt, Artificial Sequence
  source: /note="Description of Artificial Sequence: Synthetic oligonucleotide"
auuuaguccuaacaaguguaa

SEQ ID NO: 1060 - RNA, 21 nt, Artificial Sequence
  source: /note="Description of Artificial Sequence: Synthetic oligonucleotide"
guccuaacaaguguagagcua

SEQ ID NO: 1061 - RNA, 21 nt, Artificial Sequence
  source: /note="Description of Artificial Sequence: Synthetic oligonucleotide"
aguccuaacaaguguagagca

SEQ ID NO: 1062 - RNA, 21 nt, Artificial Sequence
  source: /note="Description of Artificial Sequence: Synthetic oligonucleotide"
gucauuuuaagaauuagcaca

SEQ ID NO: 1063 - RNA, 21 nt, Artificial Sequence
  source: /note="Description of Artificial Sequence: Synthetic oligonucleotide"
aacacuggacuaauaggaaua

SEQ ID NO: 1064 - RNA, 21 nt, Artificial Sequence
  source: /note="Description of Artificial Sequence: Synthetic oligonucleotide"
caacacuggacuaauaggaaa

SEQ ID NO: 1065 - RNA, 21 nt, Artificial Sequence
  source: /note="Description of Artificial Sequence: Synthetic oligonucleotide"
acuggacuaauaggaauaaca

SEQ ID NO: 1066 - RNA, 21 nt, Artificial Sequence
  source: /note="Description of Artificial Sequence: Synthetic oligonucleotide"
cuggacuaauaggaauaacua

SEQ ID NO: 1067 - RNA, 21 nt, Artificial Sequence
  source: /note="Description of Artificial Sequence: Synthetic oligonucleotide"
uggacuaauaggaauaacuua

SEQ ID NO: 1068 - RNA, 21 nt, Artificial Sequence
  source: /note="Description of Artificial Sequence: Synthetic oligonucleotide"
gacuaauaggaauaacuuuua

SEQ ID NO: 1069 - RNA, 23 nt, Artificial Sequence
  source: /note="Description of Artificial Sequence: Synthetic oligonucleotide"
aauucaaguuaaaccacugcuug

SEQ ID NO: 1070 - RNA, 23 nt, Artificial Sequence
  source: /note="Description of Artificial Sequence: Synthetic oligonucleotide"
aaauucaaguuaaaccacugcuu

SEQ ID NO: 1071 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
caaauatagaauaaccuucuugc

SEQ ID NO: 1072 - RNA, 23 nt, Artificial Sequence
  source: /note="Description of Artificial Sequence: Synthetic oligonucleotide"
acaaauauagaauaaccuucuug

SEQ ID NO: 1073 - RNA, 23 nt, Artificial Sequence
  source: /note="Description of Artificial Sequence: Synthetic oligonucleotide"
aucuccaauaaguuuuggucgau

SEQ ID NO: 1074 - RNA, 23 nt, Artificial Sequence
  source: /note="Description of Artificial Sequence: Synthetic oligonucleotide"
auuuucaaaguaggcuucucguc

SEQ ID NO: 1075 - RNA, 23 nt, Artificial Sequence
  source: /note="Description of Artificial Sequence: Synthetic oligonucleotide"
uauguuuauuugucuggagccaa

SEQ ID NO: 1076 - RNA, 23 nt, Artificial Sequence
  source: /note="Description of Artificial Sequence: Synthetic oligonucleotide"
uagauggacuccauguuuauuug

SEQ ID NO: 1077 - RNA, 23 nt, Artificial Sequence
  source: /note="Description of Artificial Sequence: Synthetic oligonucleotide"
uuuucucguggaagauggacucc

SEQ ID NO: 1078 - RNA, 23 nt, Artificial Sequence
  source: /note="Description of Artificial Sequence: Synthetic oligonucleotide"
ugcuaaaauacucuccuugcaau

SEQ ID NO: 1079 - RNA, 23 nt, Artificial Sequence
  source: /note="Description of Artificial Sequence: Synthetic oligonucleotide"
uggcuaaaauacucuccuugcaa

SEQ ID NO: 1080 - RNA, 23 nt, Artificial Sequence
  source: /note="Description of Artificial Sequence: Synthetic oligonucleotide"
uaaaaaugugcgguagucuucac

SEQ ID NO: 1081 - RNA, 23 nt, Artificial Sequence
  source: /note="Description of Artificial Sequence: Synthetic oligonucleotide"
uguaaaaaugugcgguagucuuc

SEQ ID NO: 1082 - RNA, 23 nt, Artificial Sequence
  source: /note="Description of Artificial Sequence: Synthetic oligonucleotide"
ugcuguaaaaaugugcgguaguc

SEQ ID NO: 1083 - RNA, 23 nt, Artificial Sequence
  source: /note="Description of Artificial Sequence: Synthetic oligonucleotide"
uaaaugugcgguagucuucacua

SEQ ID NO: 1084 - RNA, 23 nt, Artificial Sequence
  source: /note="Description of Artificial Sequence: Synthetic oligonucleotide"
uaaaaugugcgguagucuucacu

SEQ ID NO: 1085 - RNA, 23 nt, Artificial Sequence
  source: /note="Description of Artificial Sequence: Synthetic oligonucleotide"
uuaaaaaugugcgguagucuuca

SEQ ID NO: 1086 - RNA, 23 nt, Artificial Sequence
  source: /note="Description of Artificial Sequence: Synthetic oligonucleotide"
ucuguaaaaaugugcgguagucu

SEQ ID NO: 1087 - RNA, 23 nt, Artificial Sequence
  source: /note="Description of Artificial Sequence: Synthetic oligonucleotide"
uugcuguaaaaaugugcgguagu

SEQ ID NO: 1088 - RNA, 23 nt, Artificial Sequence
  source: /note="Description of Artificial Sequence: Synthetic oligonucleotide"
ugcugcuguaaaaaugugcggua

SEQ ID NO: 1089 - RNA, 23 nt, Artificial Sequence
  source: /note="Description of Artificial Sequence: Synthetic oligonucleotide"
uauauuuccagaaggcugcugua

SEQ ID NO: 1090 - RNA, 23 nt, Artificial Sequence
  source: /note="Description of Artificial Sequence: Synthetic oligonucleotide"
ugaauagagaaaaagccgcuguc

SEQ ID NO: 1091 - RNA, 23 nt, Artificial Sequence
  source: /note="Description of Artificial Sequence: Synthetic oligonucleotide"
ugcuuauaacuugaauagagaaa

SEQ ID NO: 1092 - RNA, 23 nt, Artificial Sequence
  source: /note="Description of Artificial Sequence: Synthetic oligonucleotide"
uugcuuauaacuugaauagagaa

SEQ ID NO: 1093 - RNA, 23 nt, Artificial Sequence
  source: /note="Description of Artificial Sequence: Synthetic oligonucleotide"
uuagagaaaaagccgcugucauc

SEQ ID NO: 1094 - RNA, 23 nt, Artificial Sequence
  source: /note="Description of Artificial Sequence: Synthetic oligonucleotide"
uuugaauagagaaaaagccgcug

SEQ ID NO: 1095 - RNA, 23 nt, Artificial Sequence
  source: /note="Description of Artificial Sequence: Synthetic oligonucleotide"
ucauugcuuauaacuugaauaga

SEQ ID NO: 1096 - RNA, 23 nt, Artificial Sequence
  source: /note="Description of Artificial Sequence: Synthetic oligonucleotide"
uaauugcauauaaaggaucuuuc

SEQ ID NO: 1097 - RNA, 23 nt, Artificial Sequence
  source: /note="Description of Artificial Sequence: Synthetic oligonucleotide"
uucuaacuguaaaccaguguucu

SEQ ID NO: 1098 - RNA, 23 nt, Artificial Sequence
  source: /note="Description of Artificial Sequence: Synthetic oligonucleotide"
uuucuaacuguaaaccaguguuc

SEQ ID NO: 1099 - RNA, 23 nt, Artificial Sequence
  source: /note="Description of Artificial Sequence: Synthetic oligonucleotide"
uauugcauauaaaggaucuuucg

SEQ ID NO: 1100 - RNA, 23 nt, Artificial Sequence
  source: /note="Description of Artificial Sequence: Synthetic oligonucleotide"
uaccaguguucuuuauaauugca

SEQ ID NO: 1101 - RNA, 23 nt, Artificial Sequence
  source: /note="Description of Artificial Sequence: Synthetic oligonucleotide"
uacuguaaaccaguguucuuuau

SEQ ID NO: 1102 - RNA, 23 nt, Artificial Sequence
  source: /note="Description of Artificial Sequence: Synthetic oligonucleotide"
uuaacuguaaaccaguguucuuu

SEQ ID NO: 1103 - RNA, 23 nt, Artificial Sequence
  source: /note="Description of Artificial Sequence: Synthetic oligonucleotide"
uauucaaguuaaaccacugcuug

SEQ ID NO: 1104 - RNA, 23 nt, Artificial Sequence
  source: /note="Description of Artificial Sequence: Synthetic oligonucleotide"
uagaauaaccuucuugcuguaau

SEQ ID NO: 1105 - RNA, 23 nt, Artificial Sequence
  source: /note="Description of Artificial Sequence: Synthetic oligonucleotide"
uauaaccuucuugcuguaauuga

SEQ ID NO: 1106 - RNA, 23 nt, Artificial Sequence
  source: /note="Description of Artificial Sequence: Synthetic oligonucleotide"
uaauaaccuucuugcuguaauug

SEQ ID NO: 1107 - RNA, 23 nt, Artificial Sequence
  source: /note="Description of Artificial Sequence: Synthetic oligonucleotide"
uuagaauaaccuucuugcuguaa

SEQ ID NO: 1108 - RNA, 23 nt, Artificial Sequence
  source: /note="Description of Artificial Sequence: Synthetic oligonucleotide"
uuauagaauaaccuucuugcugu

SEQ ID NO: 1109 - RNA, 23 nt, Artificial Sequence
  source: /note="Description of Artificial Sequence: Synthetic oligonucleotide"
uauauagaauaaccuucuugcug

SEQ ID NO: 1110 - RNA, 23 nt, Artificial Sequence
  source: /note="Description of Artificial Sequence: Synthetic oligonucleotide"
uaauauagaauaaccuucuugcu

SEQ ID NO: 1111 - RNA, 23 nt, Artificial Sequence
  source: /note="Description of Artificial Sequence: Synthetic oligonucleotide"
ucaaucuggcagaucacccuuaa

SEQ ID NO: 1112 - RNA, 23 nt, Artificial Sequence
  source: /note="Description of Artificial Sequence: Synthetic oligonucleotide"
uaaaguuggucagcuucacaauc

SEQ ID NO: 1113 - RNA, 23 nt, Artificial Sequence
  source: /note="Description of Artificial Sequence: Synthetic oligonucleotide"
uaaaaguuggucagcuucacaau

SEQ ID NO: 1114 - RNA, 23 nt, Artificial Sequence
  source: /note="Description of Artificial Sequence: Synthetic oligonucleotide"
uuguuggaccuugaucaucugca

SEQ ID NO: 1115 - RNA, 23 nt, Artificial Sequence
  source: /note="Description of Artificial Sequence: Synthetic oligonucleotide"
uucuguuggaccuugaucaucug

SEQ ID NO: 1116 - RNA, 23 nt, Artificial Sequence
  source: /note="Description of Artificial Sequence: Synthetic oligonucleotide"
uaucuguuggaccuugaucaucu

SEQ ID NO: 1117 - RNA, 23 nt, Artificial Sequence
  source: /note="Description of Artificial Sequence: Synthetic oligonucleotide"
uguuuuggucgaugcaucuguug

SEQ ID NO: 1118 - RNA, 23 nt, Artificial Sequence
  source: /note="Description of Artificial Sequence: Synthetic oligonucleotide"
uaguuuuggucgaugcaucuguu

SEQ ID NO: 1119 - RNA, 23 nt, Artificial Sequence
  source: /note="Description of Artificial Sequence: Synthetic oligonucleotide"
uuaaguuuuggucgaugcaucug

SEQ ID NO: 1120 - RNA, 23 nt, Artificial Sequence
  source: /note="Description of Artificial Sequence: Synthetic oligonucleotide"
uauaaguuuuggucgaugcaucu

SEQ ID NO: 1121 - RNA, 23 nt, Artificial Sequence
  source: /note="Description of Artificial Sequence: Synthetic oligonucleotide"
uuccaauaaguuuuggucgaugc

SEQ ID NO: 1122 - RNA, 23 nt, Artificial Sequence
  source: /note="Description of Artificial Sequence: Synthetic oligonucleotide"
uuaccuugcauacugagcugaau

SEQ ID NO: 1123 - RNA, 23 nt, Artificial Sequence
  source: /note="Description of Artificial Sequence: Synthetic oligonucleotide"
ucuaccuugcauacugagcugaa

SEQ ID NO: 1124 - RNA, 23 nt, Artificial Sequence
  source: /note="Description of Artificial Sequence: Synthetic oligonucleotide"
uaacuaccuugcauacugagcug

SEQ ID NO: 1125 - RNA, 23 nt, Artificial Sequence
  source: /note="Description of Artificial Sequence: Synthetic oligonucleotide"
ugcuguugcuuuucaaaguaggc

SEQ ID NO: 1126 - RNA, 23 nt, Artificial Sequence
  source: /note="Description of Artificial Sequence: Synthetic oligonucleotide"
ucuuucugcuuacaaaccacuac

SEQ ID NO: 1127 - RNA, 23 nt, Artificial Sequence
  source: /note="Description of Artificial Sequence: Synthetic oligonucleotide"
uuucauugcugacugccucuuug

SEQ ID NO: 1128 - RNA, 23 nt, Artificial Sequence
  source: /note="Description of Artificial Sequence: Synthetic oligonucleotide"
ucagucagauauugcacauuuga

SEQ ID NO: 1129 - RNA, 23 nt, Artificial Sequence
  source: /note="Description of Artificial Sequence: Synthetic oligonucleotide"
uucagucagauauugcacauuug

SEQ ID NO: 1130 - RNA, 23 nt, Artificial Sequence
  source: /note="Description of Artificial Sequence: Synthetic oligonucleotide"
uccauaauuucagucagauauug

SEQ ID NO: 1131 - RNA, 23 nt, Artificial Sequence
  source: /note="Description of Artificial Sequence: Synthetic oligonucleotide"
uucagauauugcacauuugaaaa

SEQ ID NO: 1132 - RNA, 23 nt, Artificial Sequence
  source: /note="Description of Artificial Sequence: Synthetic oligonucleotide"
ugucagauauugcacauuugaaa

SEQ ID NO: 1133 - RNA, 23 nt, Artificial Sequence
  source: /note="Description of Artificial Sequence: Synthetic oligonucleotide"
ucauaauuucagucagauauugc

SEQ ID NO: 1134 - RNA, 23 nt, Artificial Sequence
  source: /note="Description of Artificial Sequence: Synthetic oligonucleotide"
ucaaguucuguggcaagagcuaa

SEQ ID NO: 1135 - RNA, 23 nt, Artificial Sequence
  source: /note="Description of Artificial Sequence: Synthetic oligonucleotide"
uucaaguucuguggcaagagcua

SEQ ID NO: 1136 - RNA, 23 nt, Artificial Sequence
  source: /note="Description of Artificial Sequence: Synthetic oligonucleotide"
uagcagccuauuuucuacuagaa

SEQ ID NO: 1137 - RNA, 23 nt, Artificial Sequence
  source: /note="Description of Artificial Sequence: Synthetic oligonucleotide"
ucauccuagcagccuauuuucua

SEQ ID NO: 1138 - RNA, 23 nt, Artificial Sequence
  source: /note="Description of Artificial Sequence: Synthetic oligonucleotide"
uuagcagccuauuuucuacuaga

SEQ ID NO: 1139 - RNA, 23 nt, Artificial Sequence
  source: /note="Description of Artificial Sequence: Synthetic oligonucleotide"
uauccuagcagccuauuuucuac

SEQ ID NO: 1140 - RNA, 23 nt, Artificial Sequence
  source: /note="Description of Artificial Sequence: Synthetic oligonucleotide"
uaauuuccacccaaaucauacca

SEQ ID NO: 1141 - RNA, 23 nt, Artificial Sequence
  source: /note="Description of Artificial Sequence: Synthetic oligonucleotide"
uauuuccacccaaaucauaccac

SEQ ID NO: 1142 - RNA, 23 nt, Artificial Sequence
  source: /note="Description of Artificial Sequence: Synthetic oligonucleotide"
ucccugauaaaaacgugugcaga

SEQ ID NO: 1143 - RNA, 23 nt, Artificial Sequence
  source: /note="Description of Artificial Sequence: Synthetic oligonucleotide"
uucccugauaaaaacgugugcag

SEQ ID NO: 1144 - RNA, 23 nt, Artificial Sequence
  source: /note="Description of Artificial Sequence: Synthetic oligonucleotide"
uuucccugauaaaaacgugugca

SEQ ID NO: 1145 - RNA, 23 nt, Artificial Sequence
  source: /note="Description of Artificial Sequence: Synthetic oligonucleotide"
uaaaacuuucccugauaaaaacg

SEQ ID NO: 1146 - RNA, 23 nt, Artificial Sequence
  source: /note="Description of Artificial Sequence: Synthetic oligonucleotide"
uagcaauaaauccuacauccaaa

SEQ ID NO: 1147 - RNA, 23 nt, Artificial Sequence
  source: /note="Description of Artificial Sequence: Synthetic oligonucleotide"
uucugaaccuuugcaauuacuga

SEQ ID NO: 1148 - RNA, 23 nt, Artificial Sequence
  source: /note="Description of Artificial Sequence: Synthetic oligonucleotide"
uaagcauuggcaucuuuucauac

SEQ ID NO: 1149 - RNA, 23 nt, Artificial Sequence
  source: /note="Description of Artificial Sequence: Synthetic oligonucleotide"
ugcauuggcaucuuuucauacug

SEQ ID NO: 1150 - RNA, 23 nt, Artificial Sequence
  source: /note="Description of Artificial Sequence: Synthetic oligonucleotide"
uuacacuuuggauacuguggcua

SEQ ID NO: 1151 - RNA, 23 nt, Artificial Sequence
  source: /note="Description of Artificial Sequence: Synthetic oligonucleotide"
uacuuuggcuucaucaagaaaaa

SEQ ID NO: 1152 - RNA, 23 nt, Artificial Sequence
  source: /note="Description of Artificial Sequence: Synthetic oligonucleotide"
ucucauuaacuuuggcuucauca

SEQ ID NO: 1153 - RNA, 23 nt, Artificial Sequence
  source: /note="Description of Artificial Sequence: Synthetic oligonucleotide"
uuacacuuguuaggacuaaauua

SEQ ID NO: 1154 - RNA, 23 nt, Artificial Sequence
  source: /note="Description of Artificial Sequence: Synthetic oligonucleotide"
uagcucuacacuuguuaggacua

SEQ ID NO: 1155 - RNA, 23 nt, Artificial Sequence
  source: /note="Description of Artificial Sequence: Synthetic oligonucleotide"
ugcucuacacuuguuaggacuaa

SEQ ID NO: 1156 - RNA, 23 nt, Artificial Sequence
  source: /note="Description of Artificial Sequence: Synthetic oligonucleotide"
ugugcuaauucuuaaaaugacag

SEQ ID NO: 1157 - RNA, 23 nt, Artificial Sequence
  source: /note="Description of Artificial Sequence: Synthetic oligonucleotide"
uauuccuauuaguccaguguugu

SEQ ID NO: 1158 - RNA, 23 nt, Artificial Sequence
  source: /note="Description of Artificial Sequence: Synthetic oligonucleotide"
uuuccuauuaguccaguguugua

SEQ ID NO: 1159 - RNA, 23 nt, Artificial Sequence
  source: /note="Description of Artificial Sequence: Synthetic oligonucleotide"
uguuauuccuauuaguccagugu

SEQ ID NO: 1160 - RNA, 23 nt, Artificial Sequence
  source: /note="Description of Artificial Sequence: Synthetic oligonucleotide"
uaguuauuccuauuaguccagug

SEQ ID NO: 1161 - RNA, 23 nt, Artificial Sequence
  source: /note="Description of Artificial Sequence: Synthetic oligonucleotide"
uaaguuauuccuauuaguccagu

SEQ ID NO: 1162 - RNA, 23 nt, Artificial Sequence
  source: /note="Description of Artificial Sequence: Synthetic oligonucleotide"
uaaaaguuauuccuauuagucca

SEQ ID NO: 1163 - RNA, 21 nt, Artificial Sequence
  source: /note="Description of Artificial Sequence: Synthetic oligonucleotide"
uuggcuccagacaaauaaaca

SEQ ID NO: 1164 - RNA, 21 nt, Artificial Sequence
  source: /note="Description of Artificial Sequence: Synthetic oligonucleotide"
ggcuccagacaaauaaacaua

SEQ ID NO: 1165 - RNA, 21 nt, Artificial Sequence
  source: /note="Description of Artificial Sequence: Synthetic oligonucleotide"
gcuccagacaaauaaacauga

SEQ ID NO: 1166 - RNA, 21 nt, Artificial Sequence
  source: /note="Description of Artificial Sequence: Synthetic oligonucleotide"
cuccagacaaauaaacaugga

SEQ ID NO: 1167 - RNA, 21 nt, Artificial Sequence
  source: /note="Description of Artificial Sequence: Synthetic oligonucleotide"
ccagacaaauaaacauggaga

SEQ ID NO: 1168 - RNA, 21 nt, Artificial Sequence
  source: /note="Description of Artificial Sequence: Synthetic oligonucleotide"
cagacaaauaaacauggagua

SEQ ID NO: 1169 - RNA, 21 nt, Artificial Sequence
  source: /note="Description of Artificial Sequence: Synthetic oligonucleotide"
agacaaauaaacauggaguca

SEQ ID NO: 1170 - RNA, 21 nt, Artificial Sequence
  source: /note="Description of Artificial Sequence: Synthetic oligonucleotide"
gaguccaucuuccacgagaaa

SEQ ID NO: 1171 - RNA, 21 nt, Artificial Sequence
  source: /note="Description of Artificial Sequence: Synthetic oligonucleotide"
uccaucuuccacgagaaacaa

SEQ ID NO: 1172 - RNA, 21 nt, Artificial Sequence
  source: /note="Description of Artificial Sequence: Synthetic oligonucleotide"
caucuuccacgagaaacaaga

SEQ ID NO: 1173 - RNA, 21 nt, Artificial Sequence
  source: /note="Description of Artificial Sequence: Synthetic oligonucleotide"
aucuuccacgagaaacaagaa

SEQ ID NO: 1174 - RNA, 21 nt, Artificial Sequence
  source: /note="Description of Artificial Sequence: Synthetic oligonucleotide"
cuuccacgagaaacaagaaga

SEQ ID NO: 1175 - RNA, 21 nt, Artificial Sequence
  source: /note="Description of Artificial Sequence: Synthetic oligonucleotide"
uuccacgagaaacaagaagga

SEQ ID NO: 1176 - RNA, 21 nt, Artificial Sequence
  source: /note="Description of Artificial Sequence: Synthetic oligonucleotide"
ccacgagaaacaagaaggcua

SEQ ID NO: 1177 - RNA, 21 nt, Artificial Sequence
  source: /note="Description of Artificial Sequence: Synthetic oligonucleotide"
uacagcagccuucuggaaaua

SEQ ID NO: 1178 - RNA, 21 nt, Artificial Sequence
  source: /note="Description of Artificial Sequence: Synthetic oligonucleotide"
cagcagccuucuggaaauaua

SEQ ID NO: 1179 - RNA, 21 nt, Artificial Sequence
  source: /note="Description of Artificial Sequence: Synthetic oligonucleotide"
agcagccuucuggaaauauga

SEQ ID NO: 1180 - RNA, 21 nt, Artificial Sequence
  source: /note="Description of Artificial Sequence: Synthetic oligonucleotide"
uucagugguuuaacuugaaua

SEQ ID NO: 1181 - RNA, 21 nt, Artificial Sequence
  source: /note="Description of Artificial Sequence: Synthetic oligonucleotide"
ucagugguuuaacuugaauua

SEQ ID NO: 1182 - RNA, 21 nt, Artificial Sequence
  source: /note="Description of Artificial Sequence: Synthetic oligonucleotide"
cagugguuuaacuugaauuca

SEQ ID NO: 1183 - RNA, 21 nt, Artificial Sequence
  source: /note="Description of Artificial Sequence: Synthetic oligonucleotide"
agugguuuaacuugaauucua

SEQ ID NO: 1184 - RNA, 21 nt, Artificial Sequence
  source: /note="Description of Artificial Sequence: Synthetic oligonucleotide"
aggaagguuauucuauauuua

SEQ ID NO: 1185 - RNA, 21 nt, Artificial Sequence
  source: /note="Description of Artificial Sequence: Synthetic oligonucleotide"
ggaagguuauucuauauuuga

SEQ ID NO: 1186 - RNA, 21 nt, Artificial Sequence
  source: /note="Description of Artificial Sequence: Synthetic oligonucleotide"
gaagguuauucuauauuugua

SEQ ID NO: 1187 - RNA, 21 nt, Artificial Sequence
  source: /note="Description of Artificial Sequence: Synthetic oligonucleotide"
aucgaccaaaacuuauuggaa

SEQ ID NO: 1188 - RNA, 21 nt, Artificial Sequence
  source: /note="Description of Artificial Sequence: Synthetic oligonucleotide"
ucgaccaaaacuuauuggaga

SEQ ID NO: 1189 - RNA, 21 nt, Artificial Sequence
  source: /note="Description of Artificial Sequence: Synthetic oligonucleotide"
cgaccaaaacuuauuggagaa

SEQ ID NO: 1190 - RNA, 21 nt, Artificial Sequence
  source: /note="Description of Artificial Sequence: Synthetic oligonucleotide"
acgagaagccuacuuugaaaa

SEQ ID NO: 1191 - RNA, 21 nt, Artificial Sequence
  source: /note="Description of Artificial Sequence: Synthetic oligonucleotide"
cgagaagccuacuuugaaaaa

SEQ ID NO: 1192 - RNA, 21 nt, Artificial Sequence
  source: /note="Description of Artificial Sequence: Synthetic oligonucleotide"
cuugggagugaucuaggugaa

SEQ ID NO: 1193 - RNA, 21 nt, Artificial Sequence
  source: /note="Description of Artificial Sequence: Synthetic oligonucleotide"
uugggagugaucuaggugaua

SEQ ID NO: 1194 - RNA, 21 nt, Artificial Sequence
  source: /note="Description of Artificial Sequence: Synthetic oligonucleotide"
ggagugaucuaggugaugcua

SEQ ID NO: 1195 - RNA, 21 nt, Artificial Sequence
  source: /note="Description of Artificial Sequence: Synthetic oligonucleotide"
gagugaucuaggugaugcuaa

SEQ ID NO: 1196 - RNA, 21 nt, Artificial Sequence
  source: /note="Description of Artificial Sequence: Synthetic oligonucleotide"
gaccaugucuuuagaaacuga

SEQ ID NO: 1197 - RNA, 21 nt, Artificial Sequence
  source: /note="Description of Artificial Sequence: Synthetic oligonucleotide"
accaugucuuuagaaacugua

SEQ ID NO: 1198 - RNA, 21 nt, Artificial Sequence
  source: /note="Description of Artificial Sequence: Synthetic oligonucleotide"
ccaugucuuuagaaacuguca

SEQ ID NO: 1199 - RNA, 21 nt, Artificial Sequence
  source: /note="Description of Artificial Sequence: Synthetic oligonucleotide"
caugucuuuagaaacugucaa

SEQ ID NO: 1200 - RNA, 21 nt, Artificial Sequence
  source: /note="Description of Artificial Sequence: Synthetic oligonucleotide"
ugucuuuagaaacugucagaa

SEQ ID NO: 1201 - RNA, 21 nt, Artificial Sequence
  source: /note="Description of Artificial Sequence: Synthetic oligonucleotide"
gucuuuagaaacugucagaaa

SEQ ID NO: 1202 - RNA, 21 nt, Artificial Sequence
  source: /note="Description of Artificial Sequence: Synthetic oligonucleotide"
cagaaaugauuugaaaacaga

SEQ ID NO: 1203 - RNA, 21 nt, Artificial Sequence
  source: /note="Description of Artificial Sequence: Synthetic oligonucleotide"
aaugauuugaaaacagaagga

SEQ ID NO: 1204 - RNA, 21 nt, Artificial Sequence
  source: /note="Description of Artificial Sequence: Synthetic oligonucleotide"
uuuuagcgguuugcaaacaaa

SEQ ID NO: 1205 - RNA, 21 nt, Artificial Sequence
  source: /note="Description of Artificial Sequence: Synthetic oligonucleotide"
uuuagcgguuugcaaacaaaa

SEQ ID NO: 1206 - RNA, 21 nt, Artificial Sequence
  source: /note="Description of Artificial Sequence: Synthetic oligonucleotide"
uuagcgguuugcaaacaaaaa

SEQ ID NO: 1207 - RNA, 21 nt, Artificial Sequence
  source: /note="Description of Artificial Sequence: Synthetic oligonucleotide"
uagcgguuugcaaacaaaaua

SEQ ID NO: 1208 - RNA, 21 nt, Artificial Sequence
  source: /note="Description of Artificial Sequence: Synthetic oligonucleotide"
agcgguuugcaaacaaaauga

SEQ ID NO: 1209 - RNA, 21 nt, Artificial Sequence
  source: /note="Description of Artificial Sequence: Synthetic oligonucleotide"
gcgguuugcaaacaaaaugaa

SEQ ID NO: 1210 - RNA, 21 nt, Artificial Sequence
  source: /note="Description of Artificial Sequence: Synthetic oligonucleotide"
guuugcaaacaaaaugaugga

SEQ ID NO: 1211 - RNA, 21 nt, Artificial Sequence
  source: /note="Description of Artificial Sequence: Synthetic oligonucleotide"
uuugcaaacaaaaugauggga

SEQ ID NO: 1212 - RNA, 21 nt, Artificial Sequence
  source: /note="Description of Artificial Sequence: Synthetic oligonucleotide"
gcauucagcaauuaaagacaa

SEQ ID NO: 1213 - RNA, 21 nt, Artificial Sequence
  source: /note="Description of Artificial Sequence: Synthetic oligonucleotide"
cauucagcaauuaaagacaua

SEQ ID NO: 1214 - RNA, 21 nt, Artificial Sequence
  source: /note="Description of Artificial Sequence: Synthetic oligonucleotide"
uuugcagacuagcuaauuaga

SEQ ID NO: 1215 - RNA, 21 nt, Artificial Sequence
  source: /note="Description of Artificial Sequence: Synthetic oligonucleotide"
uugcagacuagcuaauuagca

SEQ ID NO: 1216 - RNA, 21 nt, Artificial Sequence
  source: /note="Description of Artificial Sequence: Synthetic oligonucleotide"
ugcagacuagcuaauuagcua

SEQ ID NO: 1217 - RNA, 21 nt, Artificial Sequence
  source: /note="Description of Artificial Sequence: Synthetic oligonucleotide"
gcagacuagcuaauuagcuca

SEQ ID NO: 1218 - RNA, 21 nt, Artificial Sequence
  source: /note="Description of Artificial Sequence: Synthetic oligonucleotide"
cagacuagcuaauuagcucua

SEQ ID NO: 1219 - RNA, 21 nt, Artificial Sequence
  source: /note="Description of Artificial Sequence: Synthetic oligonucleotide"
gauguugauaauaguaaugga

SEQ ID NO: 1220 - RNA, 21 nt, Artificial Sequence
  source: /note="Description of Artificial Sequence: Synthetic oligonucleotide"
auguugauaauaguaauggua

SEQ ID NO: 1221 - RNA, 21 nt, Artificial Sequence
  source: /note="Description of Artificial Sequence: Synthetic oligonucleotide"
uguugauaauaguaaugguua

SEQ ID NO: 1222 - RNA, 21 nt, Artificial Sequence
  source: /note="Description of Artificial Sequence: Synthetic oligonucleotide"
guugauaauaguaaugguuca

SEQ ID NO: 1223 - RNA, 21 nt, Artificial Sequence
  source: /note="Description of Artificial Sequence: Synthetic oligonucleotide"
uugauaauaguaaugguucua

SEQ ID NO: 1224 - RNA, 21 nt, Artificial Sequence
  source: /note="Description of Artificial Sequence: Synthetic oligonucleotide"
ugauaauaguaaugguucuaa

SEQ ID NO: 1225 - RNA, 21 nt, Artificial Sequence
  source: /note="Description of Artificial Sequence: Synthetic oligonucleotide"
uuucugcuaccugguuuucaa

SEQ ID NO: 1226 - RNA, 21 nt, Artificial Sequence
  source: /note="Description of Artificial Sequence: Synthetic oligonucleotide"
uucugcuaccugguuuucaua

SEQ ID NO: 1227 - RNA, 21 nt, Artificial Sequence
  source: /note="Description of Artificial Sequence: Synthetic oligonucleotide"
ucugcuaccugguuuucauua

SEQ ID NO: 1228 - RNA, 21 nt, Artificial Sequence
  source: /note="Description of Artificial Sequence: Synthetic oligonucleotide"
gcuaccugguuuucauuauua

SEQ ID NO: 1229 - RNA, 21 nt, Artificial Sequence
  source: /note="Description of Artificial Sequence: Synthetic oligonucleotide"
accugguuuucauuauuuuca

SEQ ID NO: 1230 - RNA, 21 nt, Artificial Sequence
  source: /note="Description of Artificial Sequence: Synthetic oligonucleotide"
ccugguuuucauuauuuucca

SEQ ID NO: 1231 - RNA, 21 nt, Artificial Sequence
  source: /note="Description of Artificial Sequence: Synthetic oligonucleotide"
cugguuuucauuauuuuccca

SEQ ID NO: 1232 - RNA, 21 nt, Artificial Sequence
  source: /note="Description of Artificial Sequence: Synthetic oligonucleotide"
ugguuuucauuauuuucccaa

SEQ ID NO: 1233 - RNA, 21 nt, Artificial Sequence
  source: /note="Description of Artificial Sequence: Synthetic oligonucleotide"
gguuuucauuauuuucccaca

SEQ ID NO: 1234 - RNA, 21 nt, Artificial Sequence
  source: /note="Description of Artificial Sequence: Synthetic oligonucleotide"
uuuucauuauuuucccacaaa

SEQ ID NO: 1235 - RNA, 21 nt, Artificial Sequence
  source: /note="Description of Artificial Sequence: Synthetic oligonucleotide"
uuucauuauuuucccacaaua

SEQ ID NO: 1236 - RNA, 21 nt, Artificial Sequence
  source: /note="Description of Artificial Sequence: Synthetic oligonucleotide"
ucauuauuuucccacaauuca

SEQ ID NO: 1237 - RNA, 21 nt, Artificial Sequence
  source: /note="Description of Artificial Sequence: Synthetic oligonucleotide"
auuauuuucccacaauucuua

SEQ ID NO: 1238 - RNA, 21 nt, Artificial Sequence
  source: /note="Description of Artificial Sequence: Synthetic oligonucleotide"
uuauuuucccacaauucuuua

SEQ ID NO: 1239 - RNA, 21 nt, Artificial Sequence
  source: /note="Description of Artificial Sequence: Synthetic oligonucleotide"
uauuuucccacaauucuuuua

SEQ ID NO: 1240 - RNA, 21 nt, Artificial Sequence
  source: /note="Description of Artificial Sequence: Synthetic oligonucleotide"
auuuucccacaauucuuuuga

SEQ ID NO: 1241 - RNA, 21 nt, Artificial Sequence
  source: /note="Description of Artificial Sequence: Synthetic oligonucleotide"
uuuucccacaauucuuuugaa

SEQ ID NO: 1242 - RNA, 21 nt, Artificial Sequence
  source: /note="Description of Artificial Sequence: Synthetic oligonucleotide"
uuucccacaauucuuuugaaa

SEQ ID NO: 1243 - RNA, 21 nt, Artificial Sequence
  source: /note="Description of Artificial Sequence: Synthetic oligonucleotide"
uucccacaauucuuuugaaaa

SEQ ID NO: 1244 - RNA, 21 nt, Artificial Sequence
  source: /note="Description of Artificial Sequence: Synthetic oligonucleotide"
ucccacaauucuuuugaaaga

SEQ ID NO: 1245 - RNA, 21 nt, Artificial Sequence
  source: /note="Description of Artificial Sequence: Synthetic oligonucleotide"
ccacaauucuuuugaaagaua

SEQ ID NO: 1246 - RNA, 21 nt, Artificial Sequence
  source: /note="Description of Artificial Sequence: Synthetic oligonucleotide"
cuuuugaaagaugguaaucua

SEQ ID NO: 1247 - RNA, 21 nt, Artificial Sequence
  source: /note="Description of Artificial Sequence: Synthetic oligonucleotide"
uuuugaaagaugguaaucuua

SEQ ID NO: 1248 - RNA, 21 nt, Artificial Sequence
  source: /note="Description of Artificial Sequence: Synthetic oligonucleotide"
uuugaaagaugguaaucuuua

SEQ ID NO: 1249 - RNA, 21 nt, Artificial Sequence
  source: /note="Description of Artificial Sequence: Synthetic oligonucleotide"
uugaaagaugguaaucuuuua

SEQ ID NO: 1250 - RNA, 21 nt, Artificial Sequence
  source: /note="Description of Artificial Sequence: Synthetic oligonucleotide"
ugaaagaugguaaucuuuuca

SEQ ID NO: 1251 - RNA, 21 nt, Artificial Sequence
  source: /note="Description of Artificial Sequence: Synthetic oligonucleotide"
gaaagaugguaaucuuuucua

SEQ ID NO: 1252 - RNA, 21 nt, Artificial Sequence
  source: /note="Description of Artificial Sequence: Synthetic oligonucleotide"
aaagaugguaaucuuuucuga

SEQ ID NO: 1253 - RNA, 21 nt, Artificial Sequence
  source: /note="Description of Artificial Sequence: Synthetic oligonucleotide"
gacuggugcguuccuaaacua

SEQ ID NO: 1254 - RNA, 21 nt, Artificial Sequence
  source: /note="Description of Artificial Sequence: Synthetic oligonucleotide"
cuggugcguuccuaaacucua

SEQ ID NO: 1255 - RNA, 21 nt, Artificial Sequence
  source: /note="Description of Artificial Sequence: Synthetic oligonucleotide"
uggugcguuccuaaacucuga

SEQ ID NO: 1256 - RNA, 21 nt, Artificial Sequence
  source: /note="Description of Artificial Sequence: Synthetic oligonucleotide"
ggugcguuccuaaacucugaa

SEQ ID NO: 1257 - RNA, 21 nt, Artificial Sequence
  source: /note="Description of Artificial Sequence: Synthetic oligonucleotide"
gugcguuccuaaacucugaaa

SEQ ID NO: 1258 - RNA, 21 nt, Artificial Sequence
  source: /note="Description of Artificial Sequence: Synthetic oligonucleotide"
ugcguuccuaaacucugaaaa

SEQ ID NO: 1259 - RNA, 21 nt, Artificial Sequence
  source: /note="Description of Artificial Sequence: Synthetic oligonucleotide"
uuuaaaaugugugagcaugua

SEQ ID NO: 1260 - RNA, 21 nt, Artificial Sequence
  source: /note="Description of Artificial Sequence: Synthetic oligonucleotide"
uuaaaaugugugagcauguga

SEQ ID NO: 1261 - RNA, 21 nt, Artificial Sequence
  source: /note="Description of Artificial Sequence: Synthetic oligonucleotide"
ugugagcaugugcuuucccaa

SEQ ID NO: 1262 - RNA, 21 nt, Artificial Sequence
  source: /note="Description of Artificial Sequence: Synthetic oligonucleotide"
gugagcaugugcuuucccaga

SEQ ID NO: 1263 - RNA, 21 nt, Artificial Sequence
  source: /note="Description of Artificial Sequence: Synthetic oligonucleotide"
gagcaugugcuuucccagaua

SEQ ID NO: 1264 - RNA, 21 nt, Artificial Sequence
  source: /note="Description of Artificial Sequence: Synthetic oligonucleotide"
agcaugugcuuucccagauga

SEQ ID NO: 1265 - RNA, 21 nt, Artificial Sequence
  source: /note="Description of Artificial Sequence: Synthetic oligonucleotide"
caugugcuuucccagaugcua

SEQ ID NO: 1266 - RNA, 21 nt, Artificial Sequence
  source: /note="Description of Artificial Sequence: Synthetic oligonucleotide"
augugcuuucccagaugcuua

SEQ ID NO: 1267 - RNA, 21 nt, Artificial Sequence
  source: /note="Description of Artificial Sequence: Synthetic oligonucleotide"
ugugcuuucccagaugcuuua

SEQ ID NO: 1268 - RNA, 21 nt, Artificial Sequence
  source: /note="Description of Artificial Sequence: Synthetic oligonucleotide"
gcuuucccagaugcuuuauga

SEQ ID NO: 1269 - RNA, 21 nt, Artificial Sequence
  source: /note="Description of Artificial Sequence: Synthetic oligonucleotide"
cuuucccagaugcuuuaugaa

SEQ ID NO: 1270 - RNA, 21 nt, Artificial Sequence
  source: /note="Description of Artificial Sequence: Synthetic oligonucleotide"
uuucccagaugcuuuaugaaa

SEQ ID NO: 1271 - RNA, 21 nt, Artificial Sequence
  source: /note="Description of Artificial Sequence: Synthetic oligonucleotide"
uucccagaugcuuuaugaaua

SEQ ID NO: 1272 - RNA, 21 nt, Artificial Sequence
  source: /note="Description of Artificial Sequence: Synthetic oligonucleotide"
uuucacuuauaucaaaaccua

SEQ ID NO: 1273 - RNA, 21 nt, Artificial Sequence
  source: /note="Description of Artificial Sequence: Synthetic oligonucleotide"
cacuuauaucaaaaccuuaca

SEQ ID NO: 1274 - RNA, 21 nt, Artificial Sequence
  source: /note="Description of Artificial Sequence: Synthetic oligonucleotide"
cuuauaucaaaaccuuacaga

SEQ ID NO: 1275 - RNA, 21 nt, Artificial Sequence
  source: /note="Description of Artificial Sequence: Synthetic oligonucleotide"
uuauaucaaaaccuuacagca

SEQ ID NO: 1276 - RNA, 21 nt, Artificial Sequence
  source: /note="Description of Artificial Sequence: Synthetic oligonucleotide"
auaucaaaaccuuacagcuua

SEQ ID NO: 1277 - RNA, 21 nt, Artificial Sequence
  source: /note="Description of Artificial Sequence: Synthetic oligonucleotide"
aucaaaaccuuacagcuuuga

SEQ ID NO: 1278 - RNA, 21 nt, Artificial Sequence
  source: /note="Description of Artificial Sequence: Synthetic oligonucleotide"
ucaaaaccuuacagcuuugua

SEQ ID NO: 1279 - RNA, 21 nt, Artificial Sequence
  source: /note="Description of Artificial Sequence: Synthetic oligonucleotide"
caaaaccuuacagcuuuguua

SEQ ID NO: 1280 - RNA, 21 nt, Artificial Sequence
  source: /note="Description of Artificial Sequence: Synthetic oligonucleotide"
aaaaccuuacagcuuuguuga

SEQ ID NO: 1281 - RNA, 21 nt, Artificial Sequence
  source: /note="Description of Artificial Sequence: Synthetic oligonucleotide"
aaaccuuacagcuuuguugca

SEQ ID NO: 1282 - RNA, 21 nt, Artificial Sequence
  source: /note="Description of Artificial Sequence: Synthetic oligonucleotide"
aaccuuacagcuuuguugcaa

SEQ ID NO: 1283 - RNA, 21 nt, Artificial Sequence
  source: /note="Description of Artificial Sequence: Synthetic oligonucleotide"
accuuacagcuuuguugcaaa

SEQ ID NO: 1284 - RNA, 21 nt, Artificial Sequence
  source: /note="Description of Artificial Sequence: Synthetic oligonucleotide"
ccuuacagcuuuguugcaaca

SEQ ID NO: 1285 - RNA, 21 nt, Artificial Sequence
  source: /note="Description of Artificial Sequence: Synthetic oligonucleotide"
cuuacagcuuuguugcaacca

SEQ ID NO: 1286 - RNA, 21 nt, Artificial Sequence
  source: /note="Description of Artificial Sequence: Synthetic oligonucleotide"
cuucuuccugcgccuuauuua

SEQ ID NO: 1287 - RNA, 21 nt, Artificial Sequence
  source: /note="Description of Artificial Sequence: Synthetic oligonucleotide"
uucuuccugcgccuuauuuua

SEQ ID NO: 1288 - RNA, 21 nt, Artificial Sequence
  source: /note="Description of Artificial Sequence: Synthetic oligonucleotide"
ccuuucuucuccaauugagaa

SEQ ID NO: 1289 - RNA, 21 nt, Artificial Sequence
  source: /note="Description of Artificial Sequence: Synthetic oligonucleotide"
cuuucuucuccaauugagaaa

SEQ ID NO: 1290 - RNA, 21 nt, Artificial Sequence
  source: /note="Description of Artificial Sequence: Synthetic oligonucleotide"
uuucuucuccaauugagaaaa

SEQ ID NO: 1291 - RNA, 21 nt, Artificial Sequence
  source: /note="Description of Artificial Sequence: Synthetic oligonucleotide"
uucuucuccaauugagaaaaa

SEQ ID NO: 1292 - RNA, 21 nt, Artificial Sequence
  source: /note="Description of Artificial Sequence: Synthetic oligonucleotide"
cagugguuuaacuugaauuca

SEQ ID NO: 1293 - RNA, 21 nt, Artificial Sequence
  source: /note="Description of Artificial Sequence: Synthetic oligonucleotide"
agugguuuaacuugaauucua

SEQ ID NO: 1294 - RNA, 21 nt, Artificial Sequence
  source: /note="Description of Artificial Sequence: Synthetic oligonucleotide"
gaguccaucuuccacgagaaa

SEQ ID NO: 1295 - RNA, 21 nt, Artificial Sequence
  source: /note="Description of Artificial Sequence: Synthetic oligonucleotide"
caacagaugcaucgaccaaaa

SEQ ID NO: 1296 - RNA, 21 nt, Artificial Sequence
  source: /note="Description of Artificial Sequence: Synthetic oligonucleotide"
agaugcaucgaccaaaacuua

SEQ ID NO: 1297 - RNA, 21 nt, Artificial Sequence
  source: /note="Description of Artificial Sequence: Synthetic oligonucleotide"
ucgaccaaaacuuauuggaga

SEQ ID NO: 1298 - RNA, 21 nt, Artificial Sequence
  source: /note="Description of Artificial Sequence: Synthetic oligonucleotide"
guaugcaagguaguuccagaa

SEQ ID NO: 1299 - RNA, 21 nt, Artificial Sequence
  source: /note="Description of Artificial Sequence: Synthetic oligonucleotide"
agcagugguuuaacuugaaua

SEQ ID NO: 1300 - RNA, 21 nt, Artificial Sequence
  source: /note="Description of Artificial Sequence: Synthetic oligonucleotide"
gcagugguuuaacuugaauua

SEQ ID NO: 1301 - RNA, 21 nt, Artificial Sequence
  source: /note="Description of Artificial Sequence: Synthetic oligonucleotide"
aagaagguuauucuauauuua

SEQ ID NO: 1302 - RNA, 21 nt, Artificial Sequence
  source: /note="Description of Artificial Sequence: Synthetic oligonucleotide"
agaagguuauucuauauuuga

SEQ ID NO: 1303 - RNA, 21 nt, Artificial Sequence
  source: /note="Description of Artificial Sequence: Synthetic oligonucleotide"
cgaccaaaacuuauuggagaa

SEQ ID NO: 1304 - RNA, 21 nt, Artificial Sequence
  source: /note="Description of Artificial Sequence: Synthetic oligonucleotide"
cgagaagccuacuuugaaaaa

SEQ ID NO: 1305 - RNA, 21 nt, Artificial Sequence
  source: /note="Description of Artificial Sequence: Synthetic oligonucleotide"
ggcuccagacaaauaaacaua

SEQ ID NO: 1306 - RNA, 21 nt, Artificial Sequence
  source: /note="Description of Artificial Sequence: Synthetic oligonucleotide"
aauaaacauggaguccaucua

SEQ ID NO: 1307 - RNA, 21 nt, Artificial Sequence
  source: /note="Description of Artificial Sequence: Synthetic oligonucleotide"
aguccaucuuccacgagaaaa

SEQ ID NO: 1308 - RNA, 21 nt, Artificial Sequence
  source: /note="Description of Artificial Sequence: Synthetic oligonucleotide"
ugcaaggagaguauuuuagca

SEQ ID NO: 1309 - RNA, 21 nt, Artificial Sequence
  source: /note="Description of Artificial Sequence: Synthetic oligonucleotide"
gcaaggagaguauuuuagcca

SEQ ID NO: 1310 - RNA, 21 nt, Artificial Sequence
  source: /note="Description of Artificial Sequence: Synthetic oligonucleotide"
gaagacuaccgcacauuuuua

SEQ ID NO: 1311 - RNA, 21 nt, Artificial Sequence
  source: /note="Description of Artificial Sequence: Synthetic oligonucleotide"
agacuaccgcacauuuuuaca

SEQ ID NO: 1312 - RNA, 21 nt, Artificial Sequence
  source: /note="Description of Artificial Sequence: Synthetic oligonucleotide"
cuaccgcacauuuuuacagca

SEQ ID NO: 1313 - RNA, 21 nt, Artificial Sequence
  source: /note="Description of Artificial Sequence: Synthetic oligonucleotide"
gugaagacuaccgcacauuua

SEQ ID NO: 1314 - RNA, 21 nt, Artificial Sequence
  source: /note="Description of Artificial Sequence: Synthetic oligonucleotide"
ugaagacuaccgcacauuuua

SEQ ID NO: 1315 - RNA, 21 nt, Artificial Sequence
  source: /note="Description of Artificial Sequence: Synthetic oligonucleotide"
aagacuaccgcacauuuuuaa

SEQ ID NO: 1316 - RNA, 21 nt, Artificial Sequence
  source: /note="Description of Artificial Sequence: Synthetic oligonucleotide"
acuaccgcacauuuuuacaga

SEQ ID NO: 1317 - RNA, 21 nt, Artificial Sequence
  source: /note="Description of Artificial Sequence: Synthetic oligonucleotide"
uaccgcacauuuuuacagcaa

SEQ ID NO: 1318 - RNA, 21 nt, Artificial Sequence
  source: /note="Description of Artificial Sequence: Synthetic oligonucleotide"
ccgcacauuuuuacagcagca

SEQ ID NO: 1319 - RNA, 21 nt, Artificial Sequence
  source: /note="Description of Artificial Sequence: Synthetic oligonucleotide"
cagcagccuucuggaaauaua

SEQ ID NO: 1320 - RNA, 21 nt, Artificial Sequence
  source: /note="Description of Artificial Sequence: Synthetic oligonucleotide"
cagcggcuuuuucucuauuca

SEQ ID NO: 1321 - RNA, 21 nt, Artificial Sequence
  source: /note="Description of Artificial Sequence: Synthetic oligonucleotide"
ucucuauucaaguuauaagca

SEQ ID NO: 1322 - RNA, 21 nt, Artificial Sequence
  source: /note="Description of Artificial Sequence: Synthetic oligonucleotide"
cucuauucaaguuauaagcaa

SEQ ID NO: 1323 - RNA, 21 nt, Artificial Sequence
  source: /note="Description of Artificial Sequence: Synthetic oligonucleotide"
ugacagcggcuuuuucucuaa

SEQ ID NO: 1324 - RNA, 21 nt, Artificial Sequence
  source: /note="Description of Artificial Sequence: Synthetic oligonucleotide"
gcggcuuuuucucuauucaaa

SEQ ID NO: 1325 - RNA, 21 nt, Artificial Sequence
  source: /note="Description of Artificial Sequence: Synthetic oligonucleotide"
uauucaaguuauaagcaauga

SEQ ID NO: 1326 - RNA, 21 nt, Artificial Sequence
  source: /note="Description of Artificial Sequence: Synthetic oligonucleotide"
aagauccuuuauaugcaauua

SEQ ID NO: 1327 - RNA, 21 nt, Artificial Sequence
  source: /note="Description of Artificial Sequence: Synthetic oligonucleotide"
aacacugguuuacaguuagaa

SEQ ID NO: 1328 - RNA, 21 nt, Artificial Sequence
  source: /note="Description of Artificial Sequence: Synthetic oligonucleotide"
acacugguuuacaguuagaaa

SEQ ID NO: 1329 - RNA, 21 nt, Artificial Sequence
  source: /note="Description of Artificial Sequence: Synthetic oligonucleotide"
aaagauccuuuauaugcaaua

SEQ ID NO: 1330 - RNA, 21 nt, Artificial Sequence
  source: /note="Description of Artificial Sequence: Synthetic oligonucleotide"
caauuauaaagaacacuggua

SEQ ID NO: 1331 - RNA, 21 nt, Artificial Sequence
  source: /note="Description of Artificial Sequence: Synthetic oligonucleotide"
aaagaacacugguuuacagua

SEQ ID NO: 1332 - RNA, 21 nt, Artificial Sequence
  source: /note="Description of Artificial Sequence: Synthetic oligonucleotide"
agaacacugguuuacaguuaa

SEQ ID NO: 1333 - RNA, 21 nt, Artificial Sequence
  source: /note="Description of Artificial Sequence: Synthetic oligonucleotide"
agcagugguuuaacuugaaua

SEQ ID NO: 1334 - RNA, 21 nt, Artificial Sequence
  source: /note="Description of Artificial Sequence: Synthetic oligonucleotide"
uacagcaagaagguuauucua

SEQ ID NO: 1335 - RNA, 21 nt, Artificial Sequence
  source: /note="Description of Artificial Sequence: Synthetic oligonucleotide"
aauuacagcaagaagguuaua

SEQ ID NO: 1336 - RNA, 21 nt, Artificial Sequence
  source: /note="Description of Artificial Sequence: Synthetic oligonucleotide"
auuacagcaagaagguuauua

SEQ ID NO: 1337 - RNA, 21 nt, Artificial Sequence
  source: /note="Description of Artificial Sequence: Synthetic oligonucleotide"
acagcaagaagguuauucuaa

SEQ ID NO: 1338 - RNA, 21 nt, Artificial Sequence
  source: /note="Description of Artificial Sequence: Synthetic oligonucleotide"
agcaagaagguuauucuauaa

SEQ ID NO: 1339 - RNA, 21 nt, Artificial Sequence
  source: /note="Description of Artificial Sequence: Synthetic oligonucleotide"
gcaagaagguuauucuauaua

SEQ ID NO: 1340 - RNA, 21 nt, Artificial Sequence
  source: /note="Description of Artificial Sequence: Synthetic oligonucleotide"
caagaagguuauucuauauua

SEQ ID NO: 1341 - RNA, 21 nt, Artificial Sequence
  source: /note="Description of Artificial Sequence: Synthetic oligonucleotide"
aagggugaucugccagauuga

SEQ ID NO: 1342 - RNA, 21 nt, Artificial Sequence
  source: /note="Description of Artificial Sequence: Synthetic oligonucleotide"
uugugaagcugaccaacuuua

SEQ ID NO: 1343 - RNA, 21 nt, Artificial Sequence
  source: /note="Description of Artificial Sequence: Synthetic oligonucleotide"
ugugaagcugaccaacuuuua

SEQ ID NO: 1344 - RNA, 21 nt, Artificial Sequence
  source: /note="Description of Artificial Sequence: Synthetic oligonucleotide"
cagaugaucaagguccaacaa

SEQ ID NO: 1345 - RNA, 21 nt, Artificial Sequence
  source: /note="Description of Artificial Sequence: Synthetic oligonucleotide"
gaugaucaagguccaacagaa

SEQ ID NO: 1346 - RNA, 21 nt, Artificial Sequence
  source: /note="Description of Artificial Sequence: Synthetic oligonucleotide"
augaucaagguccaacagaua

SEQ ID NO: 1347 - RNA, 21 nt, Artificial Sequence
  source: /note="Description of Artificial Sequence: Synthetic oligonucleotide"
acagaugcaucgaccaaaaca

SEQ ID NO: 1348 - RNA, 21 nt, Artificial Sequence
  source: /note="Description of Artificial Sequence: Synthetic oligonucleotide"
cagaugcaucgaccaaaacua

SEQ ID NO: 1349 - RNA, 21 nt, Artificial Sequence
  source: /note="Description of Artificial Sequence: Synthetic oligonucleotide"
gaugcaucgaccaaaacuuaa

SEQ ID NO: 1350 - RNA, 21 nt, Artificial Sequence
  source: /note="Description of Artificial Sequence: Synthetic oligonucleotide"
augcaucgaccaaaacuuaua

SEQ ID NO: 1351 - RNA, 21 nt, Artificial Sequence
  source: /note="Description of Artificial Sequence: Synthetic oligonucleotide"
aucgaccaaaacuuauuggaa

SEQ ID NO: 1352 - RNA, 21 nt, Artificial Sequence
  source: /note="Description of Artificial Sequence: Synthetic oligonucleotide"
ucagcucaguaugcaagguaa

SEQ ID NO: 1353 - RNA, 21 nt, Artificial Sequence
  source: /note="Description of Artificial Sequence: Synthetic oligonucleotide"
cagcucaguaugcaagguaga

SEQ ID NO: 1354 - RNA, 21 nt, Artificial Sequence
  source: /note="Description of Artificial Sequence: Synthetic oligonucleotide"
gcucaguaugcaagguaguua

SEQ ID NO: 1355 - RNA, 21 nt, Artificial Sequence
  source: /note="Description of Artificial Sequence: Synthetic oligonucleotide"
cuacuuugaaaagcaacagca

SEQ ID NO: 1356 - RNA, 21 nt, Artificial Sequence
  source: /note="Description of Artificial Sequence: Synthetic oligonucleotide"
agugguuuguaagcagaaaga

SEQ ID NO: 1357 - RNA, 21 nt, Artificial Sequence
  source: /note="Description of Artificial Sequence: Synthetic oligonucleotide"
aagaggcagucagcaaugaaa

SEQ ID NO: 1358 - RNA, 21 nt, Artificial Sequence
  source: /note="Description of Artificial Sequence: Synthetic oligonucleotide"
aaaugugcaauaucugacuga

SEQ ID NO: 1359 - RNA, 21 nt, Artificial Sequence
  source: /note="Description of Artificial Sequence: Synthetic oligonucleotide"
aaugugcaauaucugacugaa

SEQ ID NO: 1360 - RNA, 21 nt, Artificial Sequence
  source: /note="Description of Artificial Sequence: Synthetic oligonucleotide"
auaucugacugaaauuaugga

SEQ ID NO: 1361 - RNA, 21 nt, Artificial Sequence
  source: /note="Description of Artificial Sequence: Synthetic oligonucleotide"
uucaaaugugcaauaucugaa

SEQ ID NO: 1362 - RNA, 21 nt, Artificial Sequence
  source: /note="Description of Artificial Sequence: Synthetic oligonucleotide"
ucaaaugugcaauaucugaca

SEQ ID NO: 1363 - RNA, 21 nt, Artificial Sequence
  source: /note="Description of Artificial Sequence: Synthetic oligonucleotide"
aauaucugacugaaauuauga

SEQ ID NO: 1364 - RNA, 21 nt, Artificial Sequence
  source: /note="Description of Artificial Sequence: Synthetic oligonucleotide"
agcucuugccacagaacuuga

SEQ ID NO: 1365 - RNA, 21 nt, Artificial Sequence
  source: /note="Description of Artificial Sequence: Synthetic oligonucleotide"
gcucuugccacagaacuugaa

SEQ ID NO: 1366 - RNA, 21 nt, Artificial Sequence
  source: /note="Description of Artificial Sequence: Synthetic oligonucleotide"
cuaguagaaaauaggcugcua

SEQ ID NO: 1367 - RNA, 21 nt, Artificial Sequence
  source: /note="Description of Artificial Sequence: Synthetic oligonucleotide"
gaaaauaggcugcuaggauga

SEQ ID NO: 1368 - RNA, 21 nt, Artificial Sequence
  source: /note="Description of Artificial Sequence: Synthetic oligonucleotide"
uaguagaaaauaggcugcuaa

SEQ ID NO: 1369 - RNA, 21 nt, Artificial Sequence
  source: /note="Description of Artificial Sequence: Synthetic oligonucleotide"
agaaaauaggcugcuaggaua

SEQ ID NO: 1370 - RNA, 21 nt, Artificial Sequence
  source: /note="Description of Artificial Sequence: Synthetic oligonucleotide"
guaugauuuggguggaaauua

SEQ ID NO: 1371 - RNA, 21 nt, Artificial Sequence
  source: /note="Description of Artificial Sequence: Synthetic oligonucleotide"
gguaugauuuggguggaaaua

SEQ ID NO: 1372 - RNA, 21 nt, Artificial Sequence
  source: /note="Description of Artificial Sequence: Synthetic oligonucleotide"
ugcacacguuuuuaucaggga

SEQ ID NO: 1373 - RNA, 21 nt, Artificial Sequence
  source: /note="Description of Artificial Sequence: Synthetic oligonucleotide"
gcacacguuuuuaucagggaa

SEQ ID NO: 1374 - RNA, 21 nt, Artificial Sequence
  source: /note="Description of Artificial Sequence: Synthetic oligonucleotide"
cacacguuuuuaucagggaaa

SEQ ID NO: 1375 - RNA, 21 nt, Artificial Sequence
  source: /note="Description of Artificial Sequence: Synthetic oligonucleotide"
uuuuuaucagggaaaguuuua

SEQ ID NO: 1376 - RNA, 21 nt, Artificial Sequence
  source: /note="Description of Artificial Sequence: Synthetic oligonucleotide"
uggauguaggauuuauugcua

SEQ ID NO: 1377 - RNA, 21 nt, Artificial Sequence
  source: /note="Description of Artificial Sequence: Synthetic oligonucleotide"
aguaauugcaaagguucagaa

SEQ ID NO: 1378 - RNA, 21 nt, Artificial Sequence
  source: /note="Description of Artificial Sequence: Synthetic oligonucleotide"
augaaaagaugccaaugcuua

SEQ ID NO: 1379 - RNA, 21 nt, Artificial Sequence
  source: /note="Description of Artificial Sequence: Synthetic oligonucleotide"
guaugaaaagaugccaaugca

SEQ ID NO: 1380 - RNA, 21 nt, Artificial Sequence
  source: /note="Description of Artificial Sequence: Synthetic oligonucleotide"
gccacaguauccaaaguguaa

SEQ ID NO: 1381 - RNA, 21 nt, Artificial Sequence
  source: /note="Description of Artificial Sequence: Synthetic oligonucleotide"
uuucuugaugaagccaaagua

SEQ ID NO: 1382 - RNA, 21 nt, Artificial Sequence
  source: /note="Description of Artificial Sequence: Synthetic oligonucleotide"
augaagccaaaguuaaugaga

SEQ ID NO: 1383 - RNA, 21 nt, Artificial Sequence
  source: /note="Description of Artificial Sequence: Synthetic oligonucleotide"
auuuaguccuaacaaguguaa

SEQ ID NO: 1384 - RNA, 21 nt, Artificial Sequence
  source: /note="Description of Artificial Sequence: Synthetic oligonucleotide"
guccuaacaaguguagagcua

SEQ ID NO: 1385 - RNA, 21 nt, Artificial Sequence
  source: /note="Description of Artificial Sequence: Synthetic oligonucleotide"
aguccuaacaaguguagagca

SEQ ID NO: 1386 - RNA, 21 nt, Artificial Sequence
  source: /note="Description of Artificial Sequence: Synthetic oligonucleotide"
gucauuuuaagaauuagcaca

SEQ ID NO: 1387 - RNA, 21 nt, Artificial Sequence
  source: /note="Description of Artificial Sequence: Synthetic oligonucleotide"
aacacuggacuaauaggaaua

SEQ ID NO: 1388 - RNA, 21 nt, Artificial Sequence
  source: /note="Description of Artificial Sequence: Synthetic oligonucleotide"
caacacuggacuaauaggaaa

SEQ ID NO: 1389 - RNA, 21 nt, Artificial Sequence
  source: /note="Description of Artificial Sequence: Synthetic oligonucleotide"
acuggacuaauaggaauaaca

SEQ ID NO: 1390 - RNA, 21 nt, Artificial Sequence
  source: /note="Description of Artificial Sequence: Synthetic oligonucleotide"
cuggacuaauaggaauaacua

SEQ ID NO: 1391 - RNA, 21 nt, Artificial Sequence
  source: /note="Description of Artificial Sequence: Synthetic oligonucleotide"
uggacuaauaggaauaacuua

SEQ ID NO: 1392 - RNA, 21 nt, Artificial Sequence
  source: /note="Description of Artificial Sequence: Synthetic oligonucleotide"
gacuaauaggaauaacuuuua

SEQ ID NO: 1393 - RNA, 23 nt, Artificial Sequence
  source: /note="Description of Artificial Sequence: Synthetic oligonucleotide"
uguuuauuugucuggagccaacg

SEQ ID NO: 1394 - RNA, 23 nt, Artificial Sequence
  source: /note="Description of Artificial Sequence: Synthetic oligonucleotide"
uauguuuauuugucuggagccaa

SEQ ID NO: 1395 - RNA, 23 nt, Artificial Sequence
  source: /note="Description of Artificial Sequence: Synthetic oligonucleotide"
ucauguuuauuugucuggagcca

SEQ ID NO: 1396 - RNA, 23 nt, Artificial Sequence
  source: /note="Description of Artificial Sequence: Synthetic oligonucleotide"
uccauguuuauuugucuggagcc

SEQ ID NO: 1397 - RNA, 23 nt, Artificial Sequence
  source: /note="Description of Artificial Sequence: Synthetic oligonucleotide"
ucuccauguuuauuugucuggag

SEQ ID NO: 1398 - RNA, 23 nt, Artificial Sequence
  source: /note="Description of Artificial Sequence: Synthetic oligonucleotide"
uacuccauguuuauuugucugga

SEQ ID NO: 1399 - RNA, 23 nt, Artificial Sequence
  source: /note="Description of Artificial Sequence: Synthetic oligonucleotide"
ugacuccauguuuauuugucugg

SEQ ID NO: 1400 - RNA, 23 nt, Artificial Sequence
  source: /note="Description of Artificial Sequence: Synthetic oligonucleotide"
uuucucguggaagauggacucca

SEQ ID NO: 1401 - RNA, 23 nt, Artificial Sequence
  source: /note="Description of Artificial Sequence: Synthetic oligonucleotide"
uuguuucucguggaagauggacu

SEQ ID NO: 1402 - RNA, 23 nt, Artificial Sequence
  source: /note="Description of Artificial Sequence: Synthetic oligonucleotide"
ucuuguuucucguggaagaugga

SEQ ID NO: 1403 - RNA, 23 nt, Artificial Sequence
  source: /note="Description of Artificial Sequence: Synthetic oligonucleotide"
uucuuguuucucguggaagaugg

SEQ ID NO: 1404 - RNA, 23 nt, Artificial Sequence
  source: /note="Description of Artificial Sequence: Synthetic oligonucleotide"
ucuucuuguuucucguggaagau

SEQ ID NO: 1405 - RNA, 23 nt, Artificial Sequence
  source: /note="Description of Artificial Sequence: Synthetic oligonucleotide"
uccuucuuguuucucguggaaga

SEQ ID NO: 1406 - RNA, 23 nt, Artificial Sequence
  source: /note="Description of Artificial Sequence: Synthetic oligonucleotide"
uagccuucuuguuucucguggaa

SEQ ID NO: 1407 - RNA, 23 nt, Artificial Sequence
  source: /note="Description of Artificial Sequence: Synthetic oligonucleotide"
uauuuccagaaggcugcuguaaa

SEQ ID NO: 1408 - RNA, 23 nt, Artificial Sequence
  source: /note="Description of Artificial Sequence: Synthetic oligonucleotide"
uauauuuccagaaggcugcugua

SEQ ID NO: 1409 - RNA, 23 nt, Artificial Sequence
  source: /note="Description of Artificial Sequence: Synthetic oligonucleotide"
ucauauuuccagaaggcugcugu

SEQ ID NO: 1410 - RNA, 23 nt, Artificial Sequence
  source: /note="Description of Artificial Sequence: Synthetic oligonucleotide"
uauucaaguuaaaccacugaaua

SEQ ID NO: 1411 - RNA, 23 nt, Artificial Sequence
  source: /note="Description of Artificial Sequence: Synthetic oligonucleotide"
uaauucaaguuaaaccacugaau

SEQ ID NO: 1412 - RNA, 23 nt, Artificial Sequence
  source: /note="Description of Artificial Sequence: Synthetic oligonucleotide"
ugaauucaaguuaaaccacugaa

SEQ ID NO: 1413 - RNA, 23 nt, Artificial Sequence
  source: /note="Description of Artificial Sequence: Synthetic oligonucleotide"
uagaauucaaguuaaaccacuga

SEQ ID NO: 1414 - RNA, 23 nt, Artificial Sequence
  source: /note="Description of Artificial Sequence: Synthetic oligonucleotide"
uaaauauagaauaaccuuccugu

SEQ ID NO: 1415 - RNA, 23 nt, Artificial Sequence
  source: /note="Description of Artificial Sequence: Synthetic oligonucleotide"
ucaaauauagaauaaccuuccug

SEQ ID NO: 1416 - RNA, 23 nt, Artificial Sequence
  source: /note="Description of Artificial Sequence: Synthetic oligonucleotide"
uacaaauauagaauaaccuuccu

SEQ ID NO: 1417 - RNA, 23 nt, Artificial Sequence
  source: /note="Description of Artificial Sequence: Synthetic oligonucleotide"
uuccaauaaguuuuggucgaugc

SEQ ID NO: 1418 - RNA, 23 nt, Artificial Sequence
  source: /note="Description of Artificial Sequence: Synthetic oligonucleotide"
ucuccaauaaguuuuggucgaug

SEQ ID NO: 1419 - RNA, 23 nt, Artificial Sequence
  source: /note="Description of Artificial Sequence: Synthetic oligonucleotide"
uucuccaauaaguuuuggucgau

SEQ ID NO: 1420 - RNA, 23 nt, Artificial Sequence
  source: /note="Description of Artificial Sequence: Synthetic oligonucleotide"
uuuucaaaguaggcuucucgucu

SEQ ID NO: 1421 - RNA, 23 nt, Artificial Sequence
  source: /note="Description of Artificial Sequence: Synthetic oligonucleotide"
uuuuucaaaguaggcuucucguc

SEQ ID NO: 1422 - RNA, 23 nt, Artificial Sequence
  source: /note="Description of Artificial Sequence: Synthetic oligonucleotide"
uucaccuagaucacucccaagug

SEQ ID NO: 1423 - RNA, 23 nt, Artificial Sequence
  source: /note="Description of Artificial Sequence: Synthetic oligonucleotide"
uaucaccuagaucacucccaagu

SEQ ID NO: 1424 - RNA, 23 nt, Artificial Sequence
  source: /note="Description of Artificial Sequence: Synthetic oligonucleotide"
uagcaucaccuagaucacuccca

SEQ ID NO: 1425 - RNA, 23 nt, Artificial Sequence
  source: /note="Description of Artificial Sequence: Synthetic oligonucleotide"
uuagcaucaccuagaucacuccc

SEQ ID NO: 1426 - RNA, 23 nt, Artificial Sequence
  source: /note="Description of Artificial Sequence: Synthetic oligonucleotide"
ucaguuucuaaagacauggucac

SEQ ID NO: 1427 - RNA, 23 nt, Artificial Sequence
  source: /note="Description of Artificial Sequence: Synthetic oligonucleotide"
uacaguuucuaaagacaugguca

SEQ ID NO: 1428 - RNA, 23 nt, Artificial Sequence
  source: /note="Description of Artificial Sequence: Synthetic oligonucleotide"
ugacaguuucuaaagacaugguc

SEQ ID NO: 1429 - RNA, 23 nt, Artificial Sequence
  source: /note="Description of Artificial Sequence: Synthetic oligonucleotide"
uugacaguuucuaaagacauggu

SEQ ID NO: 1430 - RNA, 23 nt, Artificial Sequence
  source: /note="Description of Artificial Sequence: Synthetic oligonucleotide"
uucugacaguuucuaaagacaug

SEQ ID NO: 1431 - RNA, 23 nt, Artificial Sequence
  source: /note="Description of Artificial Sequence: Synthetic oligonucleotide"
uuucugacaguuucuaaagacau

SEQ ID NO: 1432 - RNA, 23 nt, Artificial Sequence
  source: /note="Description of Artificial Sequence: Synthetic oligonucleotide"
ucuguuuucaaaucauuucugac

SEQ ID NO: 1433 - RNA, 23 nt, Artificial Sequence
  source: /note="Description of Artificial Sequence: Synthetic oligonucleotide"
uccuucuguuuucaaaucauuuc

SEQ ID NO: 1434 - RNA, 23 nt, Artificial Sequence
  source: /note="Description of Artificial Sequence: Synthetic oligonucleotide"
uuuguuugcaaaccgcuaaaagu

SEQ ID NO: 1435 - RNA, 23 nt, Artificial Sequence
  source: /note="Description of Artificial Sequence: Synthetic oligonucleotide"
uuuuguuugcaaaccgcuaaaag

SEQ ID NO: 1436 - RNA, 23 nt, Artificial Sequence
  source: /note="Description of Artificial Sequence: Synthetic oligonucleotide"
uuuuuguuugcaaaccgcuaaaa

SEQ ID NO: 1437 - RNA, 23 nt, Artificial Sequence
  source: /note="Description of Artificial Sequence: Synthetic oligonucleotide"
uauuuuguuugcaaaccgcuaaa

SEQ ID NO: 1438 - RNA, 23 nt, Artificial Sequence
  source: /note="Description of Artificial Sequence: Synthetic oligonucleotide"
ucauuuuguuugcaaaccgcuaa

SEQ ID NO: 1439 - RNA, 23 nt, Artificial Sequence
  source: /note="Description of Artificial Sequence: Synthetic oligonucleotide"
uucauuuuguuugcaaaccgcua

SEQ ID NO: 1440 - RNA, 23 nt, Artificial Sequence
  source: /note="Description of Artificial Sequence: Synthetic oligonucleotide"
uccaucauuuuguuugcaaaccg

SEQ ID NO: 1441 - RNA, 23 nt, Artificial Sequence
  source: /note="Description of Artificial Sequence: Synthetic oligonucleotide"
ucccaucauuuuguuugcaaacc

SEQ ID NO: 1442 - RNA, 23 nt, Artificial Sequence
  source: /note="Description of Artificial Sequence: Synthetic oligonucleotide"
uugucuuuaauugcugaaugccu

SEQ ID NO: 1443 - RNA, 23 nt, Artificial Sequence
  source: /note="Description of Artificial Sequence: Synthetic oligonucleotide"
uaugucuuuaauugcugaaugcc

SEQ ID NO: 1444 - RNA, 23 nt, Artificial Sequence
  source: /note="Description of Artificial Sequence: Synthetic oligonucleotide"
ucuaauuagcuagucugcaaaaa

SEQ ID NO: 1445 - RNA, 23 nt, Artificial Sequence
  source: /note="Description of Artificial Sequence: Synthetic oligonucleotide"
ugcuaauuagcuagucugcaaaa

SEQ ID NO: 1446 - RNA, 23 nt, Artificial Sequence
  source: /note="Description of Artificial Sequence: Synthetic oligonucleotide"
uagcuaauuagcuagucugcaaa

SEQ ID NO: 1447 - RNA, 23 nt, Artificial Sequence
  source: /note="Description of Artificial Sequence: Synthetic oligonucleotide"
ugagcuaauuagcuagucugcaa

SEQ ID NO: 1448 - RNA, 23 nt, Artificial Sequence
  source: /note="Description of Artificial Sequence: Synthetic oligonucleotide"
uagagcuaauuagcuagucugca

SEQ ID NO: 1449 - RNA, 23 nt, Artificial Sequence
  source: /note="Description of Artificial Sequence: Synthetic oligonucleotide"
uccauuacuauuaucaacaucag

SEQ ID NO: 1450 - RNA, 23 nt, Artificial Sequence
  source: /note="Description of Artificial Sequence: Synthetic oligonucleotide"
uaccauuacuauuaucaacauca

SEQ ID NO: 1451 - RNA, 23 nt, Artificial Sequence
  source: /note="Description of Artificial Sequence: Synthetic oligonucleotide"
uaaccauuacuauuaucaacauc

SEQ ID NO: 1452 - RNA, 23 nt, Artificial Sequence
  source: /note="Description of Artificial Sequence: Synthetic oligonucleotide"
ugaaccauuacuauuaucaacau

SEQ ID NO: 1453 - RNA, 23 nt, Artificial Sequence
  source: /note="Description of Artificial Sequence: Synthetic oligonucleotide"
uagaaccauuacuauuaucaaca

SEQ ID NO: 1454 - RNA, 23 nt, Artificial Sequence
  source: /note="Description of Artificial Sequence: Synthetic oligonucleotide"
uuagaaccauuacuauuaucaac

SEQ ID NO: 1455 - RNA, 23 nt, Artificial Sequence
  source: /note="Description of Artificial Sequence: Synthetic oligonucleotide"
uugaaaaccagguagcagaaaag

SEQ ID NO: 1456 - RNA, 23 nt, Artificial Sequence
  source: /note="Description of Artificial Sequence: Synthetic oligonucleotide"
uaugaaaaccagguagcagaaaa

SEQ ID NO: 1457 - RNA, 23 nt, Artificial Sequence
  source: /note="Description of Artificial Sequence: Synthetic oligonucleotide"
uaaugaaaaccagguagcagaaa

SEQ ID NO: 1458 - RNA, 23 nt, Artificial Sequence
  source: /note="Description of Artificial Sequence: Synthetic oligonucleotide"
uaauaaugaaaaccagguagcag

SEQ ID NO: 1459 - RNA, 23 nt, Artificial Sequence
  source: /note="Description of Artificial Sequence: Synthetic oligonucleotide"
ugaaaauaaugaaaaccagguag

SEQ ID NO: 1460 - RNA, 23 nt, Artificial Sequence
  source: /note="Description of Artificial Sequence: Synthetic oligonucleotide"
uggaaaauaaugaaaaccaggua

SEQ ID NO: 1461 - RNA, 23 nt, Artificial Sequence
  source: /note="Description of Artificial Sequence: Synthetic oligonucleotide"
ugggaaaauaaugaaaaccaggu

SEQ ID NO: 1462 - RNA, 23 nt, Artificial Sequence
  source: /note="Description of Artificial Sequence: Synthetic oligonucleotide"
uugggaaaauaaugaaaaccagg

SEQ ID NO: 1463 - RNA, 23 nt, Artificial Sequence
  source: /note="Description of Artificial Sequence: Synthetic oligonucleotide"
ugugggaaaauaaugaaaaccag

SEQ ID NO: 1464 - RNA, 23 nt, Artificial Sequence
  source: /note="Description of Artificial Sequence: Synthetic oligonucleotide"
uuugugggaaaauaaugaaaacc

SEQ ID NO: 1465 - RNA, 23 nt, Artificial Sequence
  source: /note="Description of Artificial Sequence: Synthetic oligonucleotide"
uauugugggaaaauaaugaaaac

SEQ ID NO: 1466 - RNA, 23 nt, Artificial Sequence
  source: /note="Description of Artificial Sequence: Synthetic oligonucleotide"
ugaauugugggaaaauaaugaaa

SEQ ID NO: 1467 - RNA, 23 nt, Artificial Sequence
  source: /note="Description of Artificial Sequence: Synthetic oligonucleotide"
uaagaauugugggaaaauaauga

SEQ ID NO: 1468 - RNA, 23 nt, Artificial Sequence
  source: /note="Description of Artificial Sequence: Synthetic oligonucleotide"
uaaagaauugugggaaaauaaug

SEQ ID NO: 1469 - RNA, 23 nt, Artificial Sequence
  source: /note="Description of Artificial Sequence: Synthetic oligonucleotide"
uaaaagaauugugggaaaauaau

SEQ ID NO: 1470 - RNA, 23 nt, Artificial Sequence
  source: /note="Description of Artificial Sequence: Synthetic oligonucleotide"
ucaaaagaauugugggaaaauaa

SEQ ID NO: 1471 - RNA, 23 nt, Artificial Sequence
  source: /note="Description of Artificial Sequence: Synthetic oligonucleotide"
uucaaaagaauugugggaaaaua

SEQ ID NO: 1472 - RNA, 23 nt, Artificial Sequence
  source: /note="Description of Artificial Sequence: Synthetic oligonucleotide"
uuucaaaagaauugugggaaaau

SEQ ID NO: 1473 - RNA, 23 nt, Artificial Sequence
  source: /note="Description of Artificial Sequence: Synthetic oligonucleotide"
uuuucaaaagaauugugggaaaa

SEQ ID NO: 1474 - RNA, 23 nt, Artificial Sequence
  source: /note="Description of Artificial Sequence: Synthetic oligonucleotide"
ucuuucaaaagaauugugggaaa

SEQ ID NO: 1475 - RNA, 23 nt, Artificial Sequence
  source: /note="Description of Artificial Sequence: Synthetic oligonucleotide"
uaucuuucaaaagaauuguggga

SEQ ID NO: 1476 - RNA, 23 nt, Artificial Sequence
  source: /note="Description of Artificial Sequence: Synthetic oligonucleotide"
uagauuaccaucuuucaaaagaa

SEQ ID NO: 1477 - RNA, 23 nt, Artificial Sequence
  source: /note="Description of Artificial Sequence: Synthetic oligonucleotide"
uaagauuaccaucuuucaaaaga

SEQ ID NO: 1478 - RNA, 23 nt, Artificial Sequence
  source: /note="Description of Artificial Sequence: Synthetic oligonucleotide"
uaaagauuaccaucuuucaaaag

SEQ ID NO: 1479 - RNA, 23 nt, Artificial Sequence
  source: /note="Description of Artificial Sequence: Synthetic oligonucleotide"
uaaaagauuaccaucuuucaaaa

SEQ ID NO: 1480 - RNA, 23 nt, Artificial Sequence
  source: /note="Description of Artificial Sequence: Synthetic oligonucleotide"
ugaaaagauuaccaucuuucaaa

SEQ ID NO: 1481 - RNA, 23 nt, Artificial Sequence
  source: /note="Description of Artificial Sequence: Synthetic oligonucleotide"
uagaaaagauuaccaucuuucaa

SEQ ID NO: 1482 - RNA, 23 nt, Artificial Sequence
  source: /note="Description of Artificial Sequence: Synthetic oligonucleotide"
ucagaaaagauuaccaucuuuca

SEQ ID NO: 1483 - RNA, 23 nt, Artificial Sequence
  source: /note="Description of Artificial Sequence: Synthetic oligonucleotide"
uaguuuaggaacgcaccagucau

SEQ ID NO: 1484 - RNA, 23 nt, Artificial Sequence
  source: /note="Description of Artificial Sequence: Synthetic oligonucleotide"
uagaguuuaggaacgcaccaguc

SEQ ID NO: 1485 - RNA, 23 nt, Artificial Sequence
  source: /note="Description of Artificial Sequence: Synthetic oligonucleotide"
ucagaguuuaggaacgcaccagu

SEQ ID NO: 1486 - RNA, 23 nt, Artificial Sequence
  source: /note="Description of Artificial Sequence: Synthetic oligonucleotide"
uucagaguuuaggaacgcaccag

SEQ ID NO: 1487 - RNA, 23 nt, Artificial Sequence
  source: /note="Description of Artificial Sequence: Synthetic oligonucleotide"
uuucagaguuuaggaacgcacca

SEQ ID NO: 1488 - RNA, 23 nt, Artificial Sequence
  source: /note="Description of Artificial Sequence: Synthetic oligonucleotide"
uuuucagaguuuaggaacgcacc

SEQ ID NO: 1489 - RNA, 23 nt, Artificial Sequence
  source: /note="Description of Artificial Sequence: Synthetic oligonucleotide"
uacaugcucacacauuuuaaaaa

SEQ ID NO: 1490 - RNA, 23 nt, Artificial Sequence
  source: /note="Description of Artificial Sequence: Synthetic oligonucleotide"
ucacaugcucacacauuuuaaaa

SEQ ID NO: 1491 - RNA, 23 nt, Artificial Sequence
  source: /note="Description of Artificial Sequence: Synthetic oligonucleotide"
uugggaaagcacaugcucacaca

SEQ ID NO: 1492 - RNA, 23 nt, Artificial Sequence
  source: /note="Description of Artificial Sequence: Synthetic oligonucleotide"
ucugggaaagcacaugcucacac

SEQ ID NO: 1493 - RNA, 23 nt, Artificial Sequence
  source: /note="Description of Artificial Sequence: Synthetic oligonucleotide"
uaucugggaaagcacaugcucac

SEQ ID NO: 1494 - RNA, 23 nt, Artificial Sequence
  source: /note="Description of Artificial Sequence: Synthetic oligonucleotide"
ucaucugggaaagcacaugcuca

SEQ ID NO: 1495 - RNA, 23 nt, Artificial Sequence
  source: /note="Description of Artificial Sequence: Synthetic oligonucleotide"
uagcaucugggaaagcacaugcu

SEQ ID NO: 1496 - RNA, 23 nt, Artificial Sequence
  source: /note="Description of Artificial Sequence: Synthetic oligonucleotide"
uaagcaucugggaaagcacaugc

SEQ ID NO: 1497 - RNA, 23 nt, Artificial Sequence
  source: /note="Description of Artificial Sequence: Synthetic oligonucleotide"
uaaagcaucugggaaagcacaug

SEQ ID NO: 1498 - RNA, 23 nt, Artificial Sequence
  source: /note="Description of Artificial Sequence: Synthetic oligonucleotide"
ucauaaagcaucugggaaagcac

SEQ ID NO: 1499 - RNA, 23 nt, Artificial Sequence
  source: /note="Description of Artificial Sequence: Synthetic oligonucleotide"
uucauaaagcaucugggaaagca

SEQ ID NO: 1500 - RNA, 23 nt, Artificial Sequence
  source: /note="Description of Artificial Sequence: Synthetic oligonucleotide"
uuucauaaagcaucugggaaagc

SEQ ID NO: 1501 - RNA, 23 nt, Artificial Sequence
  source: /note="Description of Artificial Sequence: Synthetic oligonucleotide"
uauucauaaagcaucugggaaag

SEQ ID NO: 1502 - RNA, 23 nt, Artificial Sequence
  source: /note="Description of Artificial Sequence: Synthetic oligonucleotide"
uagguuuugauauaagugaaaag

SEQ ID NO: 1503 - RNA, 23 nt, Artificial Sequence
  source: /note="Description of Artificial Sequence: Synthetic oligonucleotide"
uguaagguuuugauauaagugaa

SEQ ID NO: 1504 - RNA, 23 nt, Artificial Sequence
  source: /note="Description of Artificial Sequence: Synthetic oligonucleotide"
ucuguaagguuuugauauaagug

SEQ ID NO: 1505 - RNA, 23 nt, Artificial Sequence
  source: /note="Description of Artificial Sequence: Synthetic oligonucleotide"
ugcuguaagguuuugauauaagu

SEQ ID NO: 1506 - RNA, 23 nt, Artificial Sequence
  source: /note="Description of Artificial Sequence: Synthetic oligonucleotide"
uaagcuguaagguuuugauauaa

SEQ ID NO: 1507 - RNA, 23 nt, Artificial Sequence
  source: /note="Description of Artificial Sequence: Synthetic oligonucleotide"
ucaaagcuguaagguuuugauau

SEQ ID NO: 1508 - RNA, 23 nt, Artificial Sequence
  source: /note="Description of Artificial Sequence: Synthetic oligonucleotide"
uacaaagcuguaagguuuugaua

SEQ ID NO: 1509 - RNA, 23 nt, Artificial Sequence
  source: /note="Description of Artificial Sequence: Synthetic oligonucleotide"
uaacaaagcuguaagguuuugau

SEQ ID NO: 1510 - RNA, 23 nt, Artificial Sequence
  source: /note="Description of Artificial Sequence: Synthetic oligonucleotide"
ucaacaaagcuguaagguuuuga

SEQ ID NO: 1511 - RNA, 23 nt, Artificial Sequence
  source: /note="Description of Artificial Sequence: Synthetic oligonucleotide"
ugcaacaaagcuguaagguuuug

SEQ ID NO: 1512 - RNA, 23 nt, Artificial Sequence
  source: /note="Description of Artificial Sequence: Synthetic oligonucleotide"
uugcaacaaagcuguaagguuuu

SEQ ID NO: 1513 - RNA, 23 nt, Artificial Sequence
  source: /note="Description of Artificial Sequence: Synthetic oligonucleotide"
uuugcaacaaagcuguaagguuu

SEQ ID NO: 1514 - RNA, 23 nt, Artificial Sequence
  source: /note="Description of Artificial Sequence: Synthetic oligonucleotide"
uguugcaacaaagcuguaagguu

SEQ ID NO: 1515 - RNA, 23 nt, Artificial Sequence
  source: /note="Description of Artificial Sequence: Synthetic oligonucleotide"
ugguugcaacaaagcuguaaggu

SEQ ID NO: 1516 - RNA, 23 nt, Artificial Sequence
  source: /note="Description of Artificial Sequence: Synthetic oligonucleotide"
uaaauaaggcgcaggaagaaggg

SEQ ID NO: 1517 - RNA, 23 nt, Artificial Sequence
  source: /note="Description of Artificial Sequence: Synthetic oligonucleotide"
uaaaauaaggcgcaggaagaagg

SEQ ID NO: 1518 - RNA, 23 nt, Artificial Sequence
  source: /note="Description of Artificial Sequence: Synthetic oligonucleotide"
uucucaauuggagaagaaaggaa

SEQ ID NO: 1519 - RNA, 23 nt, Artificial Sequence
  source: /note="Description of Artificial Sequence: Synthetic oligonucleotide"
uuucucaauuggagaagaaagga

SEQ ID NO: 1520 - RNA, 23 nt, Artificial Sequence
  source: /note="Description of Artificial Sequence: Synthetic oligonucleotide"
uuuucucaauuggagaagaaagg

SEQ ID NO: 1521 - RNA, 23 nt, Artificial Sequence
  source: /note="Description of Artificial Sequence: Synthetic oligonucleotide"
uuuuucucaauuggagaagaaag

SEQ ID NO: 1522 - RNA, 23 nt, Artificial Sequence
  source: /note="Description of Artificial Sequence: Synthetic oligonucleotide"
ugaauucaaguuaaaccacugcu

SEQ ID NO: 1523 - RNA, 23 nt, Artificial Sequence
  source: /note="Description of Artificial Sequence: Synthetic oligonucleotide"
uagaauucaaguuaaaccacugc

SEQ ID NO: 1524 - RNA, 23 nt, Artificial Sequence
  source: /note="Description of Artificial Sequence: Synthetic oligonucleotide"
uuucucguggaagauggacucca

SEQ ID NO: 1525 - RNA, 23 nt, Artificial Sequence
  source: /note="Description of Artificial Sequence: Synthetic oligonucleotide"
uuuuggucgaugcaucuguugga

SEQ ID NO: 1526 - RNA, 23 nt, Artificial Sequence
  source: /note="Description of Artificial Sequence: Synthetic oligonucleotide"
uaaguuuuggucgaugcaucugu

SEQ ID NO: 1527 - RNA, 23 nt, Artificial Sequence
  source: /note="Description of Artificial Sequence: Synthetic oligonucleotide"
ucuccaauaaguuuuggucgaug

SEQ ID NO: 1528 - RNA, 23 nt, Artificial Sequence
  source: /note="Description of Artificial Sequence: Synthetic oligonucleotide"
uucuggaacuaccuugcauacug

SEQ ID NO: 1529 - RNA, 23 nt, Artificial Sequence
  source: /note="Description of Artificial Sequence: Synthetic oligonucleotide"
uauucaaguuaaaccacugcuug

SEQ ID NO: 1530 - RNA, 23 nt, Artificial Sequence
  source: /note="Description of Artificial Sequence: Synthetic oligonucleotide"
uaauucaaguuaaaccacugcuu

SEQ ID NO: 1531 - RNA, 23 nt, Artificial Sequence
  source: /note="Description of Artificial Sequence: Synthetic oligonucleotide"
uaaauauagaauaaccuucuugc

SEQ ID NO: 1532 - RNA, 23 nt, Artificial Sequence
  source: /note="Description of Artificial Sequence: Synthetic oligonucleotide"
ucaaauauagaauaaccuucuug

SEQ ID NO: 1533 - RNA, 23 nt, Artificial Sequence
  source: /note="Description of Artificial Sequence: Synthetic oligonucleotide"
uucuccaauaaguuuuggucgau

SEQ ID NO: 1534 - RNA, 23 nt, Artificial Sequence
  source: /note="Description of Artificial Sequence: Synthetic oligonucleotide"
uuuuucaaaguaggcuucucguc

SEQ ID NO: 1535 - RNA, 23 nt, Artificial Sequence
  source: /note="Description of Artificial Sequence: Synthetic oligonucleotide"
uauguuuauuugucuggagccaa

SEQ ID NO: 1536 - RNA, 23 nt, Artificial Sequence
  source: /note="Description of Artificial Sequence: Synthetic oligonucleotide"
uagauggacuccauguuuauuug

SEQ ID NO: 1537 - RNA, 23 nt, Artificial Sequence
  source: /note="Description of Artificial Sequence: Synthetic oligonucleotide"
uuuucucguggaagauggacucc

SEQ ID NO: 1538 - RNA, 23 nt, Artificial Sequence
  source: /note="Description of Artificial Sequence: Synthetic oligonucleotide"
ugcuaaaauacucuccuugcaau

SEQ ID NO: 1539 - RNA, 23 nt, Artificial Sequence
  source: /note="Description of Artificial Sequence: Synthetic oligonucleotide"
uggcuaaaauacucuccuugcaa

SEQ ID NO: 1540 - RNA, 23 nt, Artificial Sequence
  source: /note="Description of Artificial Sequence: Synthetic oligonucleotide"
uaaaaaugugcgguagucuucac

SEQ ID NO: 1541 - RNA, 23 nt, Artificial Sequence
  source: /note="Description of Artificial Sequence: Synthetic oligonucleotide"
uguaaaaaugugcgguagucuuc

SEQ ID NO: 1542 - RNA, 23 nt, Artificial Sequence
  source: /note="Description of Artificial Sequence: Synthetic oligonucleotide"
ugcuguaaaaaugugcgguaguc

SEQ ID NO: 1543 - RNA, 23 nt, Artificial Sequence
  source: /note="Description of Artificial Sequence: Synthetic oligonucleotide"
uaaaugugcgguagucuucacua

SEQ ID NO: 1544 - RNA, 23 nt, Artificial Sequence
  source: /note="Description of Artificial Sequence: Synthetic oligonucleotide"
uaaaaugugcgguagucuucacu

SEQ ID NO: 1545 - RNA, 23 nt, Artificial Sequence
  source: /note="Description of Artificial Sequence: Synthetic oligonucleotide"
uuaaaaaugugcgguagucuuca

SEQ ID NO: 1546 - RNA, 23 nt, Artificial Sequence
  source: /note="Description of Artificial Sequence: Synthetic oligonucleotide"
ucuguaaaaaugugcgguagucu

SEQ ID NO: 1547 - RNA, 23 nt, Artificial Sequence
  source: /note="Description of Artificial Sequence: Synthetic oligonucleotide"
uugcuguaaaaaugugcgguagu

SEQ ID NO: 1548 - RNA, 23 nt, Artificial Sequence
  source: /note="Description of Artificial Sequence: Synthetic oligonucleotide"
ugcugcuguaaaaaugugcggua

SEQ ID NO: 1549 - RNA, 23 nt, Artificial Sequence
  source: /note="Description of Artificial Sequence: Synthetic oligonucleotide"
uauauuuccagaaggcugcugua

SEQ ID NO: 1550 - RNA, 23 nt, Artificial Sequence
  source: /note="Description of Artificial Sequence: Synthetic oligonucleotide"
ugaauagagaaaaagccgcuguc

SEQ ID NO: 1551 - RNA, 23 nt, Artificial Sequence
  source: /note="Description of Artificial Sequence: Synthetic oligonucleotide"
ugcuuauaacuugaauagagaaa

SEQ ID NO: 1552 - RNA, 23 nt, Artificial Sequence
  source: /note="Description of Artificial Sequence: Synthetic oligonucleotide"
uugcuuauaacuugaauagagaa

SEQ ID NO: 1553 - RNA, 23 nt, Artificial Sequence
  source: /note="Description of Artificial Sequence: Synthetic oligonucleotide"
uuagagaaaaagccgcugucauc

SEQ ID NO: 1554 - RNA, 23 nt, Artificial Sequence
  source: /note="Description of Artificial Sequence: Synthetic oligonucleotide"
uuugaauagagaaaaagccgcug

SEQ ID NO: 1555 - RNA, 23 nt, Artificial Sequence
  source: /note="Description of Artificial Sequence: Synthetic oligonucleotide"
ucauugcuuauaacuugaauaga

SEQ ID NO: 1556 - RNA, 23 nt, Artificial Sequence
  source: /note="Description of Artificial Sequence: Synthetic oligonucleotide"
uaauugcauauaaaggaucuuuc

SEQ ID NO: 1557 - RNA, 23 nt, Artificial Sequence
  source: /note="Description of Artificial Sequence: Synthetic oligonucleotide"
uucuaacuguaaaccaguguucu

SEQ ID NO: 1558 - RNA, 23 nt, Artificial Sequence
  source: /note="Description of Artificial Sequence: Synthetic oligonucleotide"
uuucuaacuguaaaccaguguuc

SEQ ID NO: 1559 - RNA, 23 nt, Artificial Sequence
  source: /note="Description of Artificial Sequence: Synthetic oligonucleotide"
uauugcauauaaaggaucuuucg

SEQ ID NO: 1560 - RNA, 23 nt, Artificial Sequence
  source: /note="Description of Artificial Sequence: Synthetic oligonucleotide"
uaccaguguucuuuauaauugca

SEQ ID NO: 1561 - RNA, 23 nt, Artificial Sequence
  source: /note="Description of Artificial Sequence: Synthetic oligonucleotide"
uacuguaaaccaguguucuuuau

SEQ ID NO: 1562 - RNA, 23 nt, Artificial Sequence
  source: /note="Description of Artificial Sequence: Synthetic oligonucleotide"
uuaacuguaaaccaguguucuuu

SEQ ID NO: 1563 - RNA, 23 nt, Artificial Sequence
  source: /note="Description of Artificial Sequence: Synthetic oligonucleotide"
uauucaaguuaaaccacugcuug

SEQ ID NO: 1564 - RNA, 23 nt, Artificial Sequence
  source: /note="Description of Artificial Sequence: Synthetic oligonucleotide"
uagaauaaccuucuugcuguaau

SEQ ID NO: 1565 - RNA, 23 nt, Artificial Sequence
  source: /note="Description of Artificial Sequence: Synthetic oligonucleotide"
uauaaccuucuugcuguaauuga

SEQ ID NO: 1566 - RNA, 23 nt, Artificial Sequence
  source: /note="Description of Artificial Sequence: Synthetic oligonucleotide"
uaauaaccuucuugcuguaauug

SEQ ID NO: 1567 - RNA, 23 nt, Artificial Sequence
  source: /note="Description of Artificial Sequence: Synthetic oligonucleotide"
uuagaauaaccuucuugcuguaa

SEQ ID NO: 1568 - RNA, 23 nt, Artificial Sequence
  source: /note="Description of Artificial Sequence: Synthetic oligonucleotide"
uuauagaauaaccuucuugcugu

SEQ ID NO: 1569 - RNA, 23 nt, Artificial Sequence
  source: /note="Description of Artificial Sequence: Synthetic oligonucleotide"
uauauagaauaaccuucuugcug

SEQ ID NO: 1570 - RNA, 23 nt, Artificial Sequence
  source: /note="Description of Artificial Sequence: Synthetic oligonucleotide"
uaauauagaauaaccuucuugcu

SEQ ID NO: 1571 - RNA, 23 nt, Artificial Sequence
  source: /note="Description of Artificial Sequence: Synthetic oligonucleotide"
ucaaucuggcagaucacccuuaa

SEQ ID NO: 1572 - RNA, 23 nt, Artificial Sequence
  source: /note="Description of Artificial Sequence: Synthetic oligonucleotide"
uaaaguuggucagcuucacaauc

SEQ ID NO: 1573 - RNA, 23 nt, Artificial Sequence
  source: /note="Description of Artificial Sequence: Synthetic oligonucleotide"
uaaaaguuggucagcuucacaau

SEQ ID NO: 1574 - RNA, 23 nt, Artificial Sequence
  source: /note="Description of Artificial Sequence: Synthetic oligonucleotide"
uuguuggaccuugaucaucugca

SEQ ID NO: 1575 - RNA, 23 nt, Artificial Sequence
  source: /note="Description of Artificial Sequence: Synthetic oligonucleotide"
uucuguuggaccuugaucaucug

SEQ ID NO: 1576 - RNA, 23 nt, Artificial Sequence
  source: /note="Description of Artificial Sequence: Synthetic oligonucleotide"
uaucuguuggaccuugaucaucu

SEQ ID NO: 1577 - RNA, 23 nt, Artificial Sequence
  source: /note="Description of Artificial Sequence: Synthetic oligonucleotide"
uguuuuggucgaugcaucuguug

SEQ ID NO: 1578 - RNA, 23 nt, Artificial Sequence
  source: /note="Description of Artificial Sequence: Synthetic oligonucleotide"
uaguuuuggucgaugcaucuguu

SEQ ID NO: 1579 - RNA, 23 nt, Artificial Sequence
  source: /note="Description of Artificial Sequence: Synthetic oligonucleotide"
uuaaguuuuggucgaugcaucug

SEQ ID NO: 1580 - RNA, 23 nt, Artificial Sequence
  source: /note="Description of Artificial Sequence: Synthetic oligonucleotide"
uauaaguuuuggucgaugcaucu

SEQ ID NO: 1581 - RNA, 23 nt, Artificial Sequence
  source: /note="Description of Artificial Sequence: Synthetic oligonucleotide"
uuccaauaaguuuuggucgaugc

SEQ ID NO: 1582 - RNA, 23 nt, Artificial Sequence
  source: /note="Description of Artificial Sequence: Synthetic oligonucleotide"
uuaccuugcauacugagcugaau

SEQ ID NO: 1583 - RNA, 23 nt, Artificial Sequence
  source: /note="Description of Artificial Sequence: Synthetic oligonucleotide"
ucuaccuugcauacugagcugaa

SEQ ID NO: 1584 - RNA, 23 nt, Artificial Sequence
  source: /note="Description of Artificial Sequence: Synthetic oligonucleotide"
uaacuaccuugcauacugagcug

SEQ ID NO: 1585 - RNA, 23 nt, Artificial Sequence
  source: /note="Description of Artificial Sequence: Synthetic oligonucleotide"
ugcuguugcuuuucaaaguaggc

SEQ ID NO: 1586 - RNA, 23 nt, Artificial Sequence
  source: /note="Description of Artificial Sequence: Synthetic oligonucleotide"
ucuuucugcuuacaaaccacuac

SEQ ID NO: 1587 - RNA, 23 nt, Artificial Sequence
  source: /note="Description of Artificial Sequence: Synthetic oligonucleotide"
uuucauugcugacugccucuuug

SEQ ID NO: 1588 - RNA, 23 nt, Artificial Sequence
  source: /note="Description of Artificial Sequence: Synthetic oligonucleotide"
ucagucagauauugcacauuuga

SEQ ID NO: 1589 - RNA, 23 nt, Artificial Sequence
  source: /note="Description of Artificial Sequence: Synthetic oligonucleotide"
uucagucagauauugcacauuug

SEQ ID NO: 1590 - RNA, 23 nt, Artificial Sequence
  source: /note="Description of Artificial Sequence: Synthetic oligonucleotide"
uccauaauuucagucagauauug

SEQ ID NO: 1591 - RNA, 23 nt, Artificial Sequence
  source: /note="Description of Artificial Sequence: Synthetic oligonucleotide"
uucagauauugcacauuugaaaa

SEQ ID NO: 1592 - RNA, 23 nt, Artificial Sequence
  source: /note="Description of Artificial Sequence: Synthetic oligonucleotide"
ugucagauauugcacauuugaaa

SEQ ID NO: 1593 - RNA, 23 nt, Artificial Sequence
  source: /note="Description of Artificial Sequence: Synthetic oligonucleotide"
ucauaauuucagucagauauugc

SEQ ID NO: 1594 - RNA, 23 nt, Artificial Sequence
  source: /note="Description of Artificial Sequence: Synthetic oligonucleotide"
ucaaguucuguggcaagagcuaa

SEQ ID NO: 1595 - RNA, 23 nt, Artificial Sequence
  source: /note="Description of Artificial Sequence: Synthetic oligonucleotide"
uucaaguucuguggcaagagcua

SEQ ID NO: 1596 - RNA, 23 nt, Artificial Sequence
  source: /note="Description of Artificial Sequence: Synthetic oligonucleotide"
uagcagccuauuuucuacuagaa

SEQ ID NO: 1597 - RNA, 23 nt, Artificial Sequence
  source: /note="Description of Artificial Sequence: Synthetic oligonucleotide"
ucauccuagcagccuauuuucua

SEQ ID NO: 1598 - RNA, 23 nt, Artificial Sequence
  source: /note="Description of Artificial Sequence: Synthetic oligonucleotide"
uuagcagccuauuuucuacuaga

SEQ ID NO: 1599 - RNA, 23 nt, Artificial Sequence
  source: /note="Description of Artificial Sequence: Synthetic oligonucleotide"
uauccuagcagccuauuuucuac

SEQ ID NO: 1600 - RNA, 23 nt, Artificial Sequence
  source: /note="Description of Artificial Sequence: Synthetic oligonucleotide"
uaauuuccacccaaaucauacca

SEQ ID NO: 1601 - RNA, 23 nt, Artificial Sequence
  source: /note="Description of Artificial Sequence: Synthetic oligonucleotide"
uauuuccacccaaaucauaccac

SEQ ID NO: 1602 - RNA, 23 nt, Artificial Sequence
  source: /note="Description of Artificial Sequence: Synthetic oligonucleotide"
ucccugauaaaaacgugugcaga

SEQ ID NO: 1603 - RNA, 23 nt, Artificial Sequence
  source: /note="Description of Artificial Sequence: Synthetic oligonucleotide"
uucccugauaaaaacgugugcag

SEQ ID NO: 1604 - RNA, 23 nt, Artificial Sequence
  source: /note="Description of Artificial Sequence: Synthetic oligonucleotide"
uuucccugauaaaaacgugugca

SEQ ID NO: 1605 - RNA, 23 nt, Artificial Sequence
  source: /note="Description of Artificial Sequence: Synthetic oligonucleotide"
uaaaacuuucccugauaaaaacg

SEQ ID NO: 1606 - RNA, 23 nt, Artificial Sequence
  source: /note="Description of Artificial Sequence: Synthetic oligonucleotide"
uagcaauaaauccuacauccaaa

SEQ ID NO: 1607 - RNA, 23 nt, Artificial Sequence
  source: /note="Description of Artificial Sequence: Synthetic oligonucleotide"
uucugaaccuuugcaauuacuga

SEQ ID NO: 1608 - RNA, 23 nt, Artificial Sequence
  source: /note="Description of Artificial Sequence: Synthetic oligonucleotide"
uaagcauuggcaucuuuucauac

SEQ ID NO: 1609 - RNA, 23 nt, Artificial Sequence
  source: /note="Description of Artificial Sequence: Synthetic oligonucleotide"
ugcauuggcaucuuuucauacug

SEQ ID NO: 1610 - RNA, 23 nt, Artificial Sequence
  source: /note="Description of Artificial Sequence: Synthetic oligonucleotide"
uuacacuuuggauacuguggcua

SEQ ID NO: 1611 - RNA, 23 nt, Artificial Sequence
  source: /note="Description of Artificial Sequence: Synthetic oligonucleotide"
uacuuuggcuucaucaagaaaaa

SEQ ID NO: 1612 - RNA, 23 nt, Artificial Sequence
  source: /note="Description of Artificial Sequence: Synthetic oligonucleotide"
ucucauuaacuuuggcuucauca

SEQ ID NO: 1613 - RNA, 23 nt, Artificial Sequence
  source: /note="Description of Artificial Sequence: Synthetic oligonucleotide"
uuacacuuguuaggacuaaauua

SEQ ID NO: 1614 - RNA, 23 nt, Artificial Sequence
  source: /note="Description of Artificial Sequence: Synthetic oligonucleotide"
uagcucuacacuuguuaggacua

SEQ ID NO: 1615 - RNA, 23 nt, Artificial Sequence
  source: /note="Description of Artificial Sequence: Synthetic oligonucleotide"
ugcucuacacuuguuaggacuaa

SEQ ID NO: 1616 - RNA, 23 nt, Artificial Sequence
  source: /note="Description of Artificial Sequence: Synthetic oligonucleotide"
ugugcuaauucuuaaaaugacag

SEQ ID NO: 1617 - RNA, 23 nt, Artificial Sequence
  source: /note="Description of Artificial Sequence: Synthetic oligonucleotide"
uauuccuauuaguccaguguugu

SEQ ID NO: 1618 - RNA, 23 nt, Artificial Sequence
  source: /note="Description of Artificial Sequence: Synthetic oligonucleotide"
uuuccuauuaguccaguguugua

SEQ ID NO: 1619 - RNA, 23 nt, Artificial Sequence
  source: /note="Description of Artificial Sequence: Synthetic oligonucleotide"
uguuauuccuauuaguccagugu

SEQ ID NO: 1620 - RNA, 23 nt, Artificial Sequence
  source: /note="Description of Artificial Sequence: Synthetic oligonucleotide"
uaguuauuccuauuaguccagug

SEQ ID NO: 1621 - RNA, 23 nt, Artificial Sequence
  source: /note="Description of Artificial Sequence: Synthetic oligonucleotide"
uaaguuauuccuauuaguccagu

SEQ ID NO: 1622 - RNA, 23 nt, Artificial Sequence
  source: /note="Description of Artificial Sequence: Synthetic oligonucleotide"
uaaaaguuauuccuauuagucca

SEQ ID NO: 1623 - RNA, 21 nt, Artificial Sequence
  source: /note="Description of Artificial Sequence: Synthetic oligonucleotide"
aaacugucagaaaugauuuga

SEQ ID NO: 1624 - RNA, 21 nt, Artificial Sequence
  source: /note="Description of Artificial Sequence: Synthetic oligonucleotide"
aacugucagaaaugauuugaa

SEQ ID NO: 1625 - RNA, 21 nt, Artificial Sequence
  source: /note="Description of Artificial Sequence: Synthetic oligonucleotide"
acugucagaaaugauuugaaa

SEQ ID NO: 1626 - RNA, 21 nt, Artificial Sequence
  source: /note="Description of Artificial Sequence: Synthetic oligonucleotide"
uagaaacugucagaaaugaua

SEQ ID NO: 1627 - RNA, 21 nt, Artificial Sequence
  source: /note="Description of Artificial Sequence: Synthetic oligonucleotide"
caaagagaugaggaaauaaga

SEQ ID NO: 1628 - RNA, 21 nt, Artificial Sequence
  source: /note="Description of Artificial Sequence: Synthetic oligonucleotide"
cgguuugcaaacaaaaugaua

SEQ ID NO: 1629 - RNA, 21 nt, Artificial Sequence
  source: /note="Description of Artificial Sequence: Synthetic oligonucleotide"
gaggcauucagcaauuaaaga

SEQ ID NO: 1630 - RNA, 21 nt, Artificial Sequence
  source: /note="Description of Artificial Sequence: Synthetic oligonucleotide"
aggcauucagcaauuaaagaa

SEQ ID NO: 1631 - RNA, 21 nt, Artificial Sequence
  source: /note="Description of Artificial Sequence: Synthetic oligonucleotide"
uuuuucuuggaucuuuuugca

SEQ ID NO: 1632 - RNA, 21 nt, Artificial Sequence
  source: /note="Description of Artificial Sequence: Synthetic oligonucleotide"
ggcuuucauuucuuauuaaca

SEQ ID NO: 1633 - RNA, 21 nt, Artificial Sequence
  source: /note="Description of Artificial Sequence: Synthetic oligonucleotide"
uaaccaaauuaaccuuucaga

SEQ ID NO: 1634 - RNA, 21 nt, Artificial Sequence
  source: /note="Description of Artificial Sequence: Synthetic oligonucleotide"
gcuccaguguuuucuugugua

SEQ ID NO: 1635 - RNA, 21 nt, Artificial Sequence
  source: /note="Description of Artificial Sequence: Synthetic oligonucleotide"
cuccaguguuuucuuguguua

SEQ ID NO: 1636 - RNA, 21 nt, Artificial Sequence
  source: /note="Description of Artificial Sequence: Synthetic oligonucleotide"
ucucugaucacaacuuuucua

SEQ ID NO: 1637 - RNA, 21 nt, Artificial Sequence
  source: /note="Description of Artificial Sequence: Synthetic oligonucleotide"
cucugaucacaacuuuucuga

SEQ ID NO: 1638 - RNA, 21 nt, Artificial Sequence
  source: /note="Description of Artificial Sequence: Synthetic oligonucleotide"
ucugaucacaacuuuucugca

SEQ ID NO: 1639 - RNA, 21 nt, Artificial Sequence
  source: /note="Description of Artificial Sequence: Synthetic oligonucleotide"
cugguuuucauuauuuuccca

SEQ ID NO: 1640 - RNA, 21 nt, Artificial Sequence
  source: /note="Description of Artificial Sequence: Synthetic oligonucleotide"
uuuucccacaauucuuuugaa

SEQ ID NO: 1641 - RNA, 21 nt, Artificial Sequence
  source: /note="Description of Artificial Sequence: Synthetic oligonucleotide"
uuucccacaauucuuuugaaa

SEQ ID NO: 1642 - RNA, 21 nt, Artificial Sequence
  source: /note="Description of Artificial Sequence: Synthetic oligonucleotide"
cuaccugguuuucauuauuua

SEQ ID NO: 1643 - RNA, 21 nt, Artificial Sequence
  source: /note="Description of Artificial Sequence: Synthetic oligonucleotide"
accugguuuucauuauuuuca

SEQ ID NO: 1644 - RNA, 21 nt, Artificial Sequence
  source: /note="Description of Artificial Sequence: Synthetic oligonucleotide"
cacaauucuuuugaaagauga

SEQ ID NO: 1645 - RNA, 21 nt, Artificial Sequence
  source: /note="Description of Artificial Sequence: Synthetic oligonucleotide"
uuuugaaagaugguaaucuua

SEQ ID NO: 1646 - RNA, 21 nt, Artificial Sequence
  source: /note="Description of Artificial Sequence: Synthetic oligonucleotide"
gaaagaugguaaucuuuucua

SEQ ID NO: 1647 - RNA, 21 nt, Artificial Sequence
  source: /note="Description of Artificial Sequence: Synthetic oligonucleotide"
uuccuaaacucugaaaucaga

SEQ ID NO: 1648 - RNA, 21 nt, Artificial Sequence
  source: /note="Description of Artificial Sequence: Synthetic oligonucleotide"
caaguacuugagaauaaauga

SEQ ID NO: 1649 - RNA, 21 nt, Artificial Sequence
  source: /note="Description of Artificial Sequence: Synthetic oligonucleotide"
cuuucccagaugcuuuaugaa

SEQ ID NO: 1650 - RNA, 21 nt, Artificial Sequence
  source: /note="Description of Artificial Sequence: Synthetic oligonucleotide"
aaguacuugagaauaaaugaa

SEQ ID NO: 1651 - RNA, 21 nt, Artificial Sequence
  source: /note="Description of Artificial Sequence: Synthetic oligonucleotide"
uuucccagaugcuuuaugaaa

SEQ ID NO: 1652 - RNA, 21 nt, Artificial Sequence
  source: /note="Description of Artificial Sequence: Synthetic oligonucleotide"
caaaaccuuacagcuuuguua

SEQ ID NO: 1653 - RNA, 21 nt, Artificial Sequence
  source: /note="Description of Artificial Sequence: Synthetic oligonucleotide"
aaaaccuuacagcuuuguuga

SEQ ID NO: 1654 - RNA, 21 nt, Artificial Sequence
  source: /note="Description of Artificial Sequence: Synthetic oligonucleotide"
uccaucuuccacgagaaacaa

SEQ ID NO: 1655 - RNA, 21 nt, Artificial Sequence
  source: /note="Description of Artificial Sequence: Synthetic oligonucleotide"
caucuuccacgagaaacaaga

SEQ ID NO: 1656 - RNA, 21 nt, Artificial Sequence
  source: /note="Description of Artificial Sequence: Synthetic oligonucleotide"
aucuuccacgagaaacaagaa

SEQ ID NO: 1657 - RNA, 21 nt, Artificial Sequence
  source: /note="Description of Artificial Sequence: Synthetic oligonucleotide"
cagcagccuucuggaaauaua

SEQ ID NO: 1658 - RNA, 21 nt, Artificial Sequence
  source: /note="Description of Artificial Sequence: Synthetic oligonucleotide"
aggaagguuauucuauauuua

SEQ ID NO: 1659 - RNA, 21 nt, Artificial Sequence
  source: /note="Description of Artificial Sequence: Synthetic oligonucleotide"
aucgaccaaaacuuauuggaa

SEQ ID NO: 1660 - RNA, 21 nt, Artificial Sequence
  source: /note="Description of Artificial Sequence: Synthetic oligonucleotide"
acgagaagccuacuuugaaaa

SEQ ID NO: 1661 - RNA, 21 nt, Artificial Sequence
  source: /note="Description of Artificial Sequence: Synthetic oligonucleotide"
gagugaucuaggugaugcuaa

SEQ ID NO: 1662 - RNA, 21 nt, Artificial Sequence
  source: /note="Description of Artificial Sequence: Synthetic oligonucleotide"
caugucuuuagaaacugucaa

SEQ ID NO: 1663 - RNA, 21 nt, Artificial Sequence
  source: /note="Description of Artificial Sequence: Synthetic oligonucleotide"
ugucuuuagaaacugucagaa

SEQ ID NO: 1664 - RNA, 21 nt, Artificial Sequence
  source: /note="Description of Artificial Sequence: Synthetic oligonucleotide"
uuuuagcgguuugcaaacaaa

SEQ ID NO: 1665 - RNA, 21 nt, Artificial Sequence
  source: /note="Description of Artificial Sequence: Synthetic oligonucleotide"
gcgguuugcaaacaaaaugaa

SEQ ID NO: 1666 - RNA, 21 nt, Artificial Sequence
  source: /note="Description of Artificial Sequence: Synthetic oligonucleotide"
gcauucagcaauuaaagacaa

SEQ ID NO: 1667 - RNA, 21 nt, Artificial Sequence
  source: /note="Description of Artificial Sequence: Synthetic oligonucleotide"
ucgaccaaaacuuauuggaga

SEQ ID NO: 1668 - RNA, 21 nt, Artificial Sequence
  source: /note="Description of Artificial Sequence: Synthetic oligonucleotide"
uccaucuuccacgagaaacaa

SEQ ID NO: 1669 - RNA, 21 nt, Artificial Sequence
  source: /note="Description of Artificial Sequence: Synthetic oligonucleotide"
caucuuccacgagaaacaaga

SEQ ID NO: 1670 - RNA, 21 nt, Artificial Sequence
  source: /note="Description of Artificial Sequence: Synthetic oligonucleotide"
aucuuccacgagaaacaagaa

SEQ ID NO: 1671 - RNA, 21 nt, Artificial Sequence
  source: /note="Description of Artificial Sequence: Synthetic oligonucleotide"
cagcagccuucuggaaauaua

SEQ ID NO: 1672 - RNA, 21 nt, Artificial Sequence
  source: /note="Description of Artificial Sequence: Synthetic oligonucleotide"
aggaagguuauucuauauuua

SEQ ID NO: 1673 - RNA, 21 nt, Artificial Sequence
  source: /note="Description of Artificial Sequence: Synthetic oligonucleotide"
aucgaccaaaacuuauuggaa

SEQ ID NO: 1674 - RNA, 21 nt, Artificial Sequence
  source: /note="Description of Artificial Sequence: Synthetic oligonucleotide"
acgagaagccuacuuugaaaa

SEQ ID NO: 1675 - RNA, 21 nt, Artificial Sequence
  source: /note="Description of Artificial Sequence: Synthetic oligonucleotide"
gagugaucuaggugaugcuaa

SEQ ID NO: 1676 - RNA, 21 nt, Artificial Sequence
  source: /note="Description of Artificial Sequence: Synthetic oligonucleotide"
caugucuuuagaaacugucaa

SEQ ID NO: 1677 - RNA, 21 nt, Artificial Sequence
  source: /note="Description of Artificial Sequence: Synthetic oligonucleotide"
ugucuuuagaaacugucagaa

SEQ ID NO: 1678 - RNA, 21 nt, Artificial Sequence
  source: /note="Description of Artificial Sequence: Synthetic oligonucleotide"
uuuuagcgguuugcaaacaaa

SEQ ID NO: 1679 - RNA, 21 nt, Artificial Sequence
  source: /note="Description of Artificial Sequence: Synthetic oligonucleotide"
gcgguuugcaaacaaaaugaa

SEQ ID NO: 1680 - RNA, 21 nt, Artificial Sequence
  source: /note="Description of Artificial Sequence: Synthetic oligonucleotide"
gcauucagcaauuaaagacaa

SEQ ID NO: 1681 - RNA, 21 nt, Artificial Sequence
  source: /note="Description of Artificial Sequence: Synthetic oligonucleotide"
ucgaccaaaacuuauuggaga

SEQ ID NO: 1682 - RNA, 23 nt, Artificial Sequence
  source: /note="Description of Artificial Sequence: Synthetic oligonucleotide"
ucaaaucauuucugacaguuucu

SEQ ID NO: 1683 - RNA, 23 nt, Artificial Sequence
  source: /note="Description of Artificial Sequence: Synthetic oligonucleotide"
uucaaaucauuucugacaguuuc

SEQ ID NO: 1684 - RNA, 23 nt, Artificial Sequence
  source: /note="Description of Artificial Sequence: Synthetic oligonucleotide"
uuucaaaucauuucugacaguuu

SEQ ID NO: 1685 - RNA, 23 nt, Artificial Sequence
  source: /note="Description of Artificial Sequence: Synthetic oligonucleotide"
uaucauuucugacaguuucuaaa

SEQ ID NO: 1686 - RNA, 23 nt, Artificial Sequence
  source: /note="Description of Artificial Sequence: Synthetic oligonucleotide"
ucuuauuuccucaucucuuugac

SEQ ID NO: 1687 - RNA, 23 nt, Artificial Sequence
  source: /note="Description of Artificial Sequence: Synthetic oligonucleotide"
uaucauuuuguuugcaaaccgcu

SEQ ID NO: 1688 - RNA, 23 nt, Artificial Sequence
  source: /note="Description of Artificial Sequence: Synthetic oligonucleotide"
ucuuuaauugcugaaugccucuu

SEQ ID NO: 1689 - RNA, 23 nt, Artificial Sequence
  source: /note="Description of Artificial Sequence: Synthetic oligonucleotide"
uucuuuaauugcugaaugccucu

SEQ ID NO: 1690 - RNA, 23 nt, Artificial Sequence
  source: /note="Description of Artificial Sequence: Synthetic oligonucleotide"
ugcaaaaagauccaagaaaaaug

SEQ ID NO: 1691 - RNA, 23 nt, Artificial Sequence
  source: /note="Description of Artificial Sequence: Synthetic oligonucleotide"
uguuaauaagaaaugaaagccac

SEQ ID NO: 1692 - RNA, 23 nt, Artificial Sequence
  source: /note="Description of Artificial Sequence: Synthetic oligonucleotide"
ucugaaagguuaauuugguuaau

SEQ ID NO: 1693 - RNA, 23 nt, Artificial Sequence
  source: /note="Description of Artificial Sequence: Synthetic oligonucleotide"
uacacaagaaaacacuggagcac

SEQ ID NO: 1694 - RNA, 23 nt, Artificial Sequence
  source: /note="Description of Artificial Sequence: Synthetic oligonucleotide"
uaacacaagaaaacacuggagca

SEQ ID NO: 1695 - RNA, 23 nt, Artificial Sequence
  source: /note="Description of Artificial Sequence: Synthetic oligonucleotide"
uagaaaaguugugaucagagaaa

SEQ ID NO: 1696 - RNA, 23 nt, Artificial Sequence
  source: /note="Description of Artificial Sequence: Synthetic oligonucleotide"
ucagaaaaguugugaucagagaa

SEQ ID NO: 1697 - RNA, 23 nt, Artificial Sequence
  source: /note="Description of Artificial Sequence: Synthetic oligonucleotide"
ugcagaaaaguugugaucagaga

SEQ ID NO: 1698 - RNA, 23 nt, Artificial Sequence
  source: /note="Description of Artificial Sequence: Synthetic oligonucleotide"
ugggaaaauaaugaaaaccaggu

SEQ ID NO: 1699 - RNA, 23 nt, Artificial Sequence
  source: /note="Description of Artificial Sequence: Synthetic oligonucleotide"
uucaaaagaauugugggaaaaua

SEQ ID NO: 1700 - RNA, 23 nt, Artificial Sequence
  source: /note="Description of Artificial Sequence: Synthetic oligonucleotide"
uuucaaaagaauugugggaaaau

SEQ ID NO: 1701 - RNA, 23 nt, Artificial Sequence
  source: /note="Description of Artificial Sequence: Synthetic oligonucleotide"
uaaauaaugaaaaccagguagca

SEQ ID NO: 1702 - RNA, 23 nt, Artificial Sequence
  source: /note="Description of Artificial Sequence: Synthetic oligonucleotide"
ugaaaauaaugaaaaccagguag

SEQ ID NO: 1703 - RNA, 23 nt, Artificial Sequence
  source: /note="Description of Artificial Sequence: Synthetic oligonucleotide"
ucaucuuucaaaagaauuguggg

SEQ ID NO: 1704 - RNA, 23 nt, Artificial Sequence
  source: /note="Description of Artificial Sequence: Synthetic oligonucleotide"
uaagauuaccaucuuucaaaaga

SEQ ID NO: 1705 - RNA, 23 nt, Artificial Sequence
  source: /note="Description of Artificial Sequence: Synthetic oligonucleotide"
uagaaaagauuaccaucuuucaa

SEQ ID NO: 1706 - RNA, 23 nt, Artificial Sequence
  source: /note="Description of Artificial Sequence: Synthetic oligonucleotide"
ucugauuucagaguuuaggaacg

SEQ ID NO: 1707 - RNA, 23 nt, Artificial Sequence
  source: /note="Description of Artificial Sequence: Synthetic oligonucleotide"
ucauuuauucucaaguacuugug

SEQ ID NO: 1708 - RNA, 23 nt, Artificial Sequence
  source: /note="Description of Artificial Sequence: Synthetic oligonucleotide"
uucauaaagcaucugggaaagca

SEQ ID NO: 1709 - RNA, 23 nt, Artificial Sequence
  source: /note="Description of Artificial Sequence: Synthetic oligonucleotide"
uucauuuauucucaaguacuugu

SEQ ID NO: 1710 - RNA, 23 nt, Artificial Sequence
  source: /note="Description of Artificial Sequence: Synthetic oligonucleotide"
uuucauaaagcaucugggaaagc

SEQ ID NO: 1711 - RNA, 23 nt, Artificial Sequence
  source: /note="Description of Artificial Sequence: Synthetic oligonucleotide"
uaacaaagcuguaagguuuugau

SEQ ID NO: 1712 - RNA, 23 nt, Artificial Sequence
  source: /note="Description of Artificial Sequence: Synthetic oligonucleotide"
ucaacaaagcuguaagguuuuga

SEQ ID NO: 1713 - RNA, 23 nt, Artificial Sequence
  source: /note="Description of Artificial Sequence: Synthetic oligonucleotide"
uuguuucucguggaagauggacu

SEQ ID NO: 1714 - RNA, 23 nt, Artificial Sequence
  source: /note="Description of Artificial Sequence: Synthetic oligonucleotide"
ucuuguuucucguggaagaugga

SEQ ID NO: 1715 - RNA, 23 nt, Artificial Sequence
  source: /note="Description of Artificial Sequence: Synthetic oligonucleotide"
uucuuguuucucguggaagaugg

SEQ ID NO: 1716 - RNA, 23 nt, Artificial Sequence
  source: /note="Description of Artificial Sequence: Synthetic oligonucleotide"
uauauuuccagaaggcugcugua

SEQ ID NO: 1717 - RNA, 23 nt, Artificial Sequence
  source: /note="Description of Artificial Sequence: Synthetic oligonucleotide"
uaaauauagaauaaccuuccugu

SEQ ID NO: 1718 - RNA, 23 nt, Artificial Sequence
  source: /note="Description of Artificial Sequence: Synthetic oligonucleotide"
uuccaauaaguuuuggucgaugc

SEQ ID NO: 1719 - RNA, 23 nt, Artificial Sequence
  source: /note="Description of Artificial Sequence: Synthetic oligonucleotide"
uuuucaaaguaggcuucucgucu

SEQ ID NO: 1720 - RNA, 23 nt, Artificial Sequence
  source: /note="Description of Artificial Sequence: Synthetic oligonucleotide"
uuagcaucaccuagaucacuccc

SEQ ID NO: 1721 - RNA, 23 nt, Artificial Sequence
  source: /note="Description of Artificial Sequence: Synthetic oligonucleotide"
uugacaguuucuaaagacauggu

SEQ ID NO: 1722 - RNA, 23 nt, Artificial Sequence
  source: /note="Description of Artificial Sequence: Synthetic oligonucleotide"
uucugacaguuucuaaagacaug

SEQ ID NO: 1723 - RNA, 23 nt, Artificial Sequence
  source: /note="Description of Artificial Sequence: Synthetic oligonucleotide"
uuuguuugcaaaccgcuaaaagu

SEQ ID NO: 1724 - RNA, 23 nt, Artificial Sequence
  source: /note="Description of Artificial Sequence: Synthetic oligonucleotide"
uucauuuuguuugcaaaccgcua

SEQ ID NO: 1725 - RNA, 23 nt, Artificial Sequence
  source: /note="Description of Artificial Sequence: Synthetic oligonucleotide"
uugucuuuaauugcugaaugccu

SEQ ID NO: 1726 - RNA, 23 nt, Artificial Sequence
  source: /note="Description of Artificial Sequence: Synthetic oligonucleotide"
ucuccaauaaguuuuggucgaug

SEQ ID NO: 1727 - RNA, 23 nt, Artificial Sequence
  source: /note="Description of Artificial Sequence: Synthetic oligonucleotide"
uuguuucucguggaagauggacu

SEQ ID NO: 1728 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuugutucucguggaagaugga

SEQ ID NO: 1729 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucuugtuucucguggaagaugg

SEQ ID NO: 1730 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauauutccagaaggcugcugua

SEQ ID NO: 1731 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaauatagaauaaccuuccugu

SEQ ID NO: 1732 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuccaataaguuuuggucgaugc

SEQ ID NO: 1733 - RNA, 23 nt, Artificial Sequence
  source: /note="Description of Artificial Sequence: Synthetic oligonucleotide"
uuuucaaaguaggcuucucgucu

SEQ ID NO: 1734 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuagcatcaccuagaucacuccc

SEQ ID NO: 1735 - RNA, 23 nt, Artificial Sequence
  source: /note="Description of Artificial Sequence: Synthetic oligonucleotide"
uugacaguuucuaaagacauggu

SEQ ID NO: 1736 - RNA, 23 nt, Artificial Sequence
  source: /note="Description of Artificial Sequence: Synthetic oligonucleotide"
uucugacaguuucuaaagacaug

SEQ ID NO: 1737 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuguutgcaaaccgcuaaaagu

SEQ ID NO: 1738 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucauutuguuugcaaaccgcua

SEQ ID NO: 1739 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugucutuaauugcugaaugccu

SEQ ID NO: 1740 - RNA, 23 nt, Artificial Sequence
  source: /note="Description of Artificial Sequence: Synthetic oligonucleotide"
ucuccaauaaguuuuggucgaug

SEQ ID NO: 1741 - DNA, 23 bp, Homo sapiens
agaaactgtcagaaatgatttga

SEQ ID NO: 1742 - DNA, 23 bp, Homo sapiens
gaaactgtcagaaatgatttgaa

SEQ ID NO: 1743 - DNA, 23 bp, Homo sapiens
aaactgtcagaaatgatttgaaa

SEQ ID NO: 1744 - RNA, 23 nt, Homo sapiens
uuuagaaacugucagaaaugauu

SEQ ID NO: 1745 - DNA, 23 bp, Homo sapiens
gtcaaagagatgaggaaataaga

SEQ ID NO: 1746 - RNA, 23 nt, Homo sapiens
agcgguuugcaaacaaaaugaug

SEQ ID NO: 1747 - DNA, 23 bp, Homo sapiens
aagaggcattcagcaattaaaga

SEQ ID NO: 1748 - RNA, 23 nt, Homo sapiens
agaggcauucagcaauuaaagac

SEQ ID NO: 1749 - DNA, 23 bp, Homo sapiens
catttttcttggatctttttgca

SEQ ID NO: 1750 - RNA, 23 nt, Homo sapiens
guggcuuucauuucuuauuaacc

SEQ ID NO: 1751 - RNA, 23 nt, Homo sapiens
auuaaccaaauuaaccuuucagg

SEQ ID NO: 1752 - RNA, 23 nt, Homo sapiens
gugcuccaguguuuucuuguguu

SEQ ID NO: 1753 - RNA, 23 nt, Homo sapiens
ugcuccaguguuuucuuguguug

SEQ ID NO: 1754 - RNA, 23 nt, Homo sapiens
uuucucugaucacaacuuuucug

SEQ ID NO: 1755 - RNA, 23 nt, Homo sapiens
uucucugaucacaacuuuucugc

SEQ ID NO: 1756 - RNA, 23 nt, Homo sapiens
ucucugaucacaacuuuucugcu

SEQ ID NO: 1757 - DNA, 23 bp, Homo sapiens
acctggttttcattattttccca

SEQ ID NO: 1758 - DNA, 23 bp, Homo sapiens
tattttcccacaattcttttgaa

SEQ ID NO: 1759 - DNA, 23 bp, Homo sapiens
attttcccacaattcttttgaaa

SEQ ID NO: 1760 - RNA, 23 nt, Homo sapiens
ugcuaccugguuuucauuauuuu

SEQ ID NO: 1761 - RNA, 23 nt, Homo sapiens
cuaccugguuuucauuauuuucc

SEQ ID NO: 1762 - RNA, 23 nt, Homo sapiens
cccacaauucuuuugaaagaugg

SEQ ID NO: 1763 - RNA, 23 nt, Homo sapiens
ucuuuugaaagaugguaaucuuu

SEQ ID NO: 1764 - RNA, 23 nt, Homo sapiens
uugaaagaugguaaucuuuucug

SEQ ID NO: 1765 - RNA, 23 nt, Homo sapiens
cguuccuaaacucugaaaucagc

SEQ ID NO: 1766 - DNA, 23 bp, Homo sapiens
cacaagtacttgagaataaatga

SEQ ID NO: 1767 - DNA, 23 bp, Homo sapiens
tgctttcccagatgctttatgaa

SEQ ID NO: 1768 - RNA, 23 nt, Homo sapiens
acaaguacuugagaauaaaugag

SEQ ID NO: 1769 - RNA, 23 nt, Homo sapiens
gcuuucccagaugcuuuaugaau

SEQ ID NO: 1770 - RNA, 23 nt, Homo sapiens
aucaaaaccuuacagcuuuguug

SEQ ID NO: 1771 - RNA, 23 nt, Homo sapiens
ucaaaaccuuacagcuuuguugc

SEQ ID NO: 1772 - DNA, 23 bp, Homo sapiens
agtccatcttccacgagaaacaa

SEQ ID NO: 1773 - DNA, 23 bp, Homo sapiens
tccatcttccacgagaaacaaga

SEQ ID NO: 1774 - DNA, 23 bp, Homo sapiens
ccatcttccacgagaaacaagaa

SEQ ID NO: 1775 - DNA, 23 bp, Homo sapiens
tacagcagccttctggaaatatg

SEQ ID NO: 1776 - DNA, 23 bp, Homo sapiens
acaggaaggttattctatatttg

SEQ ID NO: 1777 - DNA, 23 bp, Homo sapiens
gcatcgaccaaaacttattggag

SEQ ID NO: 1778 - DNA, 23 bp, Homo sapiens
agacgagaagcctactttgaaaa

SEQ ID NO: 1779 - RNA, 23 nt, Homo sapiens
gggagugaucuaggugaugcuau

SEQ ID NO: 1780 - RNA, 23 nt, Homo sapiens
accaugucuuuagaaacugucag

SEQ ID NO: 1781 - RNA, 23 nt, Homo sapiens
caugucuuuagaaacugucagaa

SEQ ID NO: 1782 - RNA, 23 nt, Homo sapiens
acuuuuagcgguuugcaaacaaa

SEQ ID NO: 1783 - RNA, 23 nt, Homo sapiens
uagcgguuugcaaacaaaaugau

SEQ ID NO: 1784 - RNA, 23 nt, Homo sapiens
aggcauucagcaauuaaagacau

SEQ ID NO: 1785 - DNA, 23 bp, Homo sapiens
catcgaccaaaacttattggaga

SEQ ID NO: 1786 - DNA, 23 bp, Homo sapiens
agtccatcttccacgagaaacaa

SEQ ID NO: 1787 - DNA, 23 bp, Homo sapiens
tccatcttccacgagaaacaaga

SEQ ID NO: 1788 - DNA, 23 bp, Homo sapiens
ccatcttccacgagaaacaagaa

SEQ ID NO: 1789 - DNA, 23 bp, Homo sapiens
tacagcagccttctggaaatatg

SEQ ID NO: 1790 - DNA, 23 bp, Homo sapiens
acaggaaggttattctatatttg

SEQ ID NO: 1791 - DNA, 23 bp, Homo sapiens
gcatcgaccaaaacttattggag

SEQ ID NO: 1792 - DNA, 23 bp, Homo sapiens
agacgagaagcctactttgaaaa

SEQ ID NO: 1793 - RNA, 23 nt, Homo sapiens
gggagugaucuaggugaugcuau

SEQ ID NO: 1794 - RNA, 23 nt, Homo sapiens
accaugucuuuagaaacugucag

SEQ ID NO: 1795 - DNA, 23 bp, Homo sapiens
catgtctttagaaactgtcagaa

SEQ ID NO: 1796 - DNA, 23 bp, Homo sapiens
acttttagcggtttgcaaacaaa

SEQ ID NO: 1797 - RNA, 23 nt, Homo sapiens
uagcgguuugcaaacaaaaugau

SEQ ID NO: 1798 - RNA, 23 nt, Homo sapiens
aggcauucagcaauuaaagacau

SEQ ID NO: 1799 - DNA, 23 bp, Homo sapiens
catcgaccaaaacttattggaga

SEQ ID NO: 1800 - RNA, 21 nt, Artificial Sequence
  source: /note="Description of Artificial Sequence: Synthetic oligonucleotide"
aaacugucagaaaugauuuga

SEQ ID NO: 1801 - RNA, 21 nt, Artificial Sequence
  source: /note="Description of Artificial Sequence: Synthetic oligonucleotide"
aacugucagaaaugauuugaa

SEQ ID NO: 1802 - RNA, 21 nt, Artificial Sequence
  source: /note="Description of Artificial Sequence: Synthetic oligonucleotide"
acugucagaaaugauuugaaa

SEQ ID NO: 1803 - RNA, 21 nt, Artificial Sequence
  source: /note="Description of Artificial Sequence: Synthetic oligonucleotide"
uagaaacugucagaaaugaua

SEQ ID NO: 1804 - RNA, 21 nt, Artificial Sequence
  source: /note="Description of Artificial Sequence: Synthetic oligonucleotide"
caaagagaugaggaaauaaga

SEQ ID NO: 1805 - RNA, 21 nt, Artificial Sequence
  source: /note="Description of Artificial Sequence: Synthetic oligonucleotide"
cgguuugcaaacaaaaugaua

SEQ ID NO: 1806 - RNA, 21 nt, Artificial Sequence
  source: /note="Description of Artificial Sequence: Synthetic oligonucleotide"
gaggcauucagcaauuaaaga

SEQ ID NO: 1807 - RNA, 21 nt, Artificial Sequence
  source: /note="Description of Artificial Sequence: Synthetic oligonucleotide"
aggcauucagcaauuaaagaa

SEQ ID NO: 1808 - RNA, 21 nt, Artificial Sequence
  source: /note="Description of Artificial Sequence: Synthetic oligonucleotide"
uuuuucuuggaucuuuuugca

SEQ ID NO: 1809 - RNA, 21 nt, Artificial Sequence
  source: /note="Description of Artificial Sequence: Synthetic oligonucleotide"
ggcuuucauuucuuauuaaca

SEQ ID NO: 1810 - RNA, 21 nt, Artificial Sequence
  source: /note="Description of Artificial Sequence: Synthetic oligonucleotide"
uaaccaaauuaaccuuucaga

SEQ ID NO: 1811 - RNA, 21 nt, Artificial Sequence
  source: /note="Description of Artificial Sequence: Synthetic oligonucleotide"
gcuccaguguuuucuugugua

SEQ ID NO: 1812 - RNA, 21 nt, Artificial Sequence
  source: /note="Description of Artificial Sequence: Synthetic oligonucleotide"
cuccaguguuuucuuguguua

SEQ ID NO: 1813 - RNA, 21 nt, Artificial Sequence
  source: /note="Description of Artificial Sequence: Synthetic oligonucleotide"
ucucugaucacaacuuuucua

SEQ ID NO: 1814 - RNA, 21 nt, Artificial Sequence
  source: /note="Description of Artificial Sequence: Synthetic oligonucleotide"
cucugaucacaacuuuucuga

SEQ ID NO: 1815 - RNA, 21 nt, Artificial Sequence
  source: /note="Description of Artificial Sequence: Synthetic oligonucleotide"
ucugaucacaacuuuucugca

SEQ ID NO: 1816 - RNA, 21 nt, Artificial Sequence
  source: /note="Description of Artificial Sequence: Synthetic oligonucleotide"
cugguuuucauuauuuuccca

SEQ ID NO: 1817 - RNA, 21 nt, Artificial Sequence
  source: /note="Description of Artificial Sequence: Synthetic oligonucleotide"
uuuucccacaauucuuuugaa

SEQ ID NO: 1818 - RNA, 21 nt, Artificial Sequence
  source: /note="Description of Artificial Sequence: Synthetic oligonucleotide"
uuucccacaauucuuuugaaa

SEQ ID NO: 1819 - RNA, 21 nt, Artificial Sequence
  source: /note="Description of Artificial Sequence: Synthetic oligonucleotide"
cuaccugguuuucauuauuua

SEQ ID NO: 1820 - RNA, 21 nt, Artificial Sequence
  source: /note="Description of Artificial Sequence: Synthetic oligonucleotide"
accugguuuucauuauuuuca

SEQ ID NO: 1821 - RNA, 21 nt, Artificial Sequence
  source: /note="Description of Artificial Sequence: Synthetic oligonucleotide"
cacaauucuuuugaaagauga

SEQ ID NO: 1822 - RNA, 21 nt, Artificial Sequence
  source: /note="Description of Artificial Sequence: Synthetic oligonucleotide"
uuuugaaagaugguaaucuua

SEQ ID NO: 1823 - RNA, 21 nt, Artificial Sequence
  source: /note="Description of Artificial Sequence: Synthetic oligonucleotide"
gaaagaugguaaucuuuucua

SEQ ID NO: 1824 - RNA, 21 nt, Artificial Sequence
  source: /note="Description of Artificial Sequence: Synthetic oligonucleotide"
uuccuaaacucugaaaucaga

SEQ ID NO: 1825 - RNA, 21 nt, Artificial Sequence
  source: /note="Description of Artificial Sequence: Synthetic oligonucleotide"
caaguacuugagaauaaauga

SEQ ID NO: 1826 - RNA, 21 nt, Artificial Sequence
  source: /note="Description of Artificial Sequence: Synthetic oligonucleotide"
cuuucccagaugcuuuaugaa

SEQ ID NO: 1827 - RNA, 21 nt, Artificial Sequence
  source: /note="Description of Artificial Sequence: Synthetic oligonucleotide"
aaguacuugagaauaaaugaa

SEQ ID NO: 1828 - RNA, 21 nt, Artificial Sequence
  source: /note="Description of Artificial Sequence: Synthetic oligonucleotide"
uuucccagaugcuuuaugaaa

SEQ ID NO: 1829 - RNA, 21 nt, Artificial Sequence
  source: /note="Description of Artificial Sequence: Synthetic oligonucleotide"
caaaaccuuacagcuuuguua

SEQ ID NO: 1830 - RNA, 21 nt, Artificial Sequence
  source: /note="Description of Artificial Sequence: Synthetic oligonucleotide"
aaaaccuuacagcuuuguuga

SEQ ID NO: 1831 - RNA, 21 nt, Artificial Sequence
  source: /note="Description of Artificial Sequence: Synthetic oligonucleotide"
uccaucuuccacgagaaacaa

SEQ ID NO: 1832 - RNA, 21 nt, Artificial Sequence
  source: /note="Description of Artificial Sequence: Synthetic oligonucleotide"
caucuuccacgagaaacaaga

SEQ ID NO: 1833 - RNA, 21 nt, Artificial Sequence
  source: /note="Description of Artificial Sequence: Synthetic oligonucleotide"
aucuuccacgagaaacaagaa

SEQ ID NO: 1834 - RNA, 21 nt, Artificial Sequence
  source: /note="Description of Artificial Sequence: Synthetic oligonucleotide"
cagcagccuucuggaaauaua

SEQ ID NO: 1835 - RNA, 21 nt, Artificial Sequence
  source: /note="Description of Artificial Sequence: Synthetic oligonucleotide"
aggaagguuauucuauauuua

SEQ ID NO: 1836 - RNA, 21 nt, Artificial Sequence
  source: /note="Description of Artificial Sequence: Synthetic oligonucleotide"
aucgaccaaaacuuauuggaa

SEQ ID NO: 1837 - RNA, 21 nt, Artificial Sequence
  source: /note="Description of Artificial Sequence: Synthetic oligonucleotide"
acgagaagccuacuuugaaaa

SEQ ID NO: 1838 - RNA, 21 nt, Artificial Sequence
  source: /note="Description of Artificial Sequence: Synthetic oligonucleotide"
gagugaucuaggugaugcuaa

SEQ ID NO: 1839 - RNA, 21 nt, Artificial Sequence
  source: /note="Description of Artificial Sequence: Synthetic oligonucleotide"
caugucuuuagaaacugucaa

SEQ ID NO: 1840 - RNA, 21 nt, Artificial Sequence
  source: /note="Description of Artificial Sequence: Synthetic oligonucleotide"
ugucuuuagaaacugucagaa

SEQ ID NO: 1841 - RNA, 21 nt, Artificial Sequence
  source: /note="Description of Artificial Sequence: Synthetic oligonucleotide"
uuuuagcgguuugcaaacaaa

SEQ ID NO: 1842 - RNA, 21 nt, Artificial Sequence
  source: /note="Description of Artificial Sequence: Synthetic oligonucleotide"
gcgguuugcaaacaaaaugaa

SEQ ID NO: 1843 - RNA, 21 nt, Artificial Sequence
  source: /note="Description of Artificial Sequence: Synthetic oligonucleotide"
gcauucagcaauuaaagacaa

SEQ ID NO: 1844 - RNA, 21 nt, Artificial Sequence
  source: /note="Description of Artificial Sequence: Synthetic oligonucleotide"
ucgaccaaaacuuauuggaga

SEQ ID NO: 1845 - RNA, 21 nt, Artificial Sequence
  source: /note="Description of Artificial Sequence: Synthetic oligonucleotide"
uccaucuuccacgagaaacaa

SEQ ID NO: 1846 - RNA, 21 nt, Artificial Sequence
  source: /note="Description of Artificial Sequence: Synthetic oligonucleotide"
caucuuccacgagaaacaaga

SEQ ID NO: 1847 - RNA, 21 nt, Artificial Sequence
  source: /note="Description of Artificial Sequence: Synthetic oligonucleotide"
aucuuccacgagaaacaagaa

SEQ ID NO: 1848 - RNA, 21 nt, Artificial Sequence
  source: /note="Description of Artificial Sequence: Synthetic oligonucleotide"
cagcagccuucuggaaauaua

SEQ ID NO: 1849 - RNA, 21 nt, Artificial Sequence
  source: /note="Description of Artificial Sequence: Synthetic oligonucleotide"
aggaagguuauucuauauuua

SEQ ID NO: 1850 - RNA, 21 nt, Artificial Sequence
  source: /note="Description of Artificial Sequence: Synthetic oligonucleotide"
aucgaccaaaacuuauuggaa

SEQ ID NO: 1851 - RNA, 21 nt, Artificial Sequence
  source: /note="Description of Artificial Sequence: Synthetic oligonucleotide"
acgagaagccuacuuugaaaa

SEQ ID NO: 1852 - RNA, 21 nt, Artificial Sequence
  source: /note="Description of Artificial Sequence: Synthetic oligonucleotide"
gagugaucuaggugaugcuaa

SEQ ID NO: 1853 - RNA, 21 nt, Artificial Sequence
  source: /note="Description of Artificial Sequence: Synthetic oligonucleotide"
caugucuuuagaaacugucaa

SEQ ID NO: 1854 - RNA, 21 nt, Artificial Sequence
  source: /note="Description of Artificial Sequence: Synthetic oligonucleotide"
ugucuuuagaaacugucagaa

SEQ ID NO: 1855 - RNA, 21 nt, Artificial Sequence
  source: /note="Description of Artificial Sequence: Synthetic oligonucleotide"
uuuuagcgguuugcaaacaaa

SEQ ID NO: 1856 - RNA, 21 nt, Artificial Sequence
  source: /note="Description of Artificial Sequence: Synthetic oligonucleotide"
gcgguuugcaaacaaaaugaa

SEQ ID NO: 1857 - RNA, 21 nt, Artificial Sequence
  source: /note="Description of Artificial Sequence: Synthetic oligonucleotide"
gcauucagcaauuaaagacaa

SEQ ID NO: 1858 - RNA, 21 nt, Artificial Sequence
  source: /note="Description of Artificial Sequence: Synthetic oligonucleotide"
ucgaccaaaacuuauuggaga

SEQ ID NO: 1859 - RNA, 23 nt, Artificial Sequence
  source: /note="Description of Artificial Sequence: Synthetic oligonucleotide"
ucaaaucauuucugacaguuucu

SEQ ID NO: 1860 - RNA, 23 nt, Artificial Sequence
  source: /note="Description of Artificial Sequence: Synthetic oligonucleotide"
uucaaaucauuucugacaguuuc

SEQ ID NO: 1861 - RNA, 23 nt, Artificial Sequence
  source: /note="Description of Artificial Sequence: Synthetic oligonucleotide"
uuucaaaucauuucugacaguuu

SEQ ID NO: 1862 - RNA, 23 nt, Artificial Sequence
  source: /note="Description of Artificial Sequence: Synthetic oligonucleotide"
uaucauuucugacaguuucuaaa

SEQ ID NO: 1863 - RNA, 23 nt, Artificial Sequence
  source: /note="Description of Artificial Sequence: Synthetic oligonucleotide"
ucuuauuuccucaucucuuugac

SEQ ID NO: 1864 - RNA, 23 nt, Artificial Sequence
  source: /note="Description of Artificial Sequence: Synthetic oligonucleotide"
uaucauuuuguuugcaaaccgcu

SEQ ID NO: 1865 - RNA, 23 nt, Artificial Sequence
  source: /note="Description of Artificial Sequence: Synthetic oligonucleotide"
ucuuuaauugcugaaugccucuu

SEQ ID NO: 1866 - RNA, 23 nt, Artificial Sequence
  source: /note="Description of Artificial Sequence: Synthetic oligonucleotide"
uucuuuaauugcugaaugccucu

SEQ ID NO: 1867 - RNA, 23 nt, Artificial Sequence
  source: /note="Description of Artificial Sequence: Synthetic oligonucleotide"
ugcaaaaagauccaagaaaaaug

SEQ ID NO: 1868 - RNA, 23 nt, Artificial Sequence
  source: /note="Description of Artificial Sequence: Synthetic oligonucleotide"
uguuaauaagaaaugaaagccac

SEQ ID NO: 1869 - RNA, 23 nt, Artificial Sequence
  source: /note="Description of Artificial Sequence: Synthetic oligonucleotide"
ucugaaagguuaauuugguuaau

SEQ ID NO: 1870 - RNA, 23 nt, Artificial Sequence
  source: /note="Description of Artificial Sequence: Synthetic oligonucleotide"
uacacaagaaaacacuggagcac

SEQ ID NO: 1871 - RNA, 23 nt, Artificial Sequence
  source: /note="Description of Artificial Sequence: Synthetic oligonucleotide"
uaacacaagaaaacacuggagca

SEQ ID NO: 1872 - RNA, 23 nt, Artificial Sequence
  source: /note="Description of Artificial Sequence: Synthetic oligonucleotide"
uagaaaaguugugaucagagaaa

SEQ ID NO: 1873 - RNA, 23 nt, Artificial Sequence
  source: /note="Description of Artificial Sequence: Synthetic oligonucleotide"
ucagaaaaguugugaucagagaa

SEQ ID NO: 1874 - RNA, 23 nt, Artificial Sequence
  source: /note="Description of Artificial Sequence: Synthetic oligonucleotide"
ugcagaaaaguugugaucagaga

SEQ ID NO: 1875 - RNA, 23 nt, Artificial Sequence
  source: /note="Description of Artificial Sequence: Synthetic oligonucleotide"
ugggaaaauaaugaaaaccaggu

SEQ ID NO: 1876 - RNA, 23 nt, Artificial Sequence
  source: /note="Description of Artificial Sequence: Synthetic oligonucleotide"
uucaaaagaauugugggaaaaua

SEQ ID NO: 1877 - RNA, 23 nt, Artificial Sequence
  source: /note="Description of Artificial Sequence: Synthetic oligonucleotide"
uuucaaaagaauugugggaaaau

SEQ ID NO: 1878 - RNA, 23 nt, Artificial Sequence
  source: /note="Description of Artificial Sequence: Synthetic oligonucleotide"
uaaauaaugaaaaccagguagca

SEQ ID NO: 1879 - RNA, 23 nt, Artificial Sequence
  source: /note="Description of Artificial Sequence: Synthetic oligonucleotide"
ugaaaauaaugaaaaccagguag

SEQ ID NO: 1880 - RNA, 23 nt, Artificial Sequence
  source: /note="Description of Artificial Sequence: Synthetic oligonucleotide"
ucaucuuucaaaagaauuguggg

SEQ ID NO: 1881 - RNA, 23 nt, Artificial Sequence
  source: /note="Description of Artificial Sequence: Synthetic oligonucleotide"
uaagauuaccaucuuucaaaaga

SEQ ID NO: 1882 - RNA, 23 nt, Artificial Sequence
  source: /note="Description of Artificial Sequence: Synthetic oligonucleotide"
uagaaaagauuaccaucuuucaa

SEQ ID NO: 1883 - RNA, 23 nt, Artificial Sequence
  source: /note="Description of Artificial Sequence: Synthetic oligonucleotide"
ucugauuucagaguuuaggaacg

SEQ ID NO: 1884 - RNA, 23 nt, Artificial Sequence
  source: /note="Description of Artificial Sequence: Synthetic oligonucleotide"
ucauuuauucucaaguacuugug

SEQ ID NO: 1885 - RNA, 23 nt, Artificial Sequence
  source: /note="Description of Artificial Sequence: Synthetic oligonucleotide"
uucauaaagcaucugggaaagca

SEQ ID NO: 1886 - RNA, 23 nt, Artificial Sequence
  source: /note="Description of Artificial Sequence: Synthetic oligonucleotide"
uucauuuauucucaaguacuugu

SEQ ID NO: 1887 - RNA, 23 nt, Artificial Sequence
  source: /note="Description of Artificial Sequence: Synthetic oligonucleotide"
uuucauaaagcaucugggaaagc

SEQ ID NO: 1888 - RNA, 23 nt, Artificial Sequence
  source: /note="Description of Artificial Sequence: Synthetic oligonucleotide"
uaacaaagcuguaagguuuugau

SEQ ID NO: 1889 - RNA, 23 nt, Artificial Sequence
  source: /note="Description of Artificial Sequence: Synthetic oligonucleotide"
ucaacaaagcuguaagguuuuga

SEQ ID NO: 1890 - RNA, 23 nt, Artificial Sequence
  source: /note="Description of Artificial Sequence: Synthetic oligonucleotide"
uuguuucucguggaagauggacu

SEQ ID NO: 1891 - RNA, 23 nt, Artificial Sequence
  source: /note="Description of Artificial Sequence: Synthetic oligonucleotide"
ucuuguuucucguggaagaugga

SEQ ID NO: 1892 - RNA, 23 nt, Artificial Sequence
  source: /note="Description of Artificial Sequence: Synthetic oligonucleotide"
uucuuguuucucguggaagaugg

SEQ ID NO: 1893 - RNA, 23 nt, Artificial Sequence
  source: /note="Description of Artificial Sequence: Synthetic oligonucleotide"
uauauuuccagaaggcugcugua

SEQ ID NO: 1894 - RNA, 23 nt, Artificial Sequence
  source: /note="Description of Artificial Sequence: Synthetic oligonucleotide"
uaaauauagaauaaccuuccugu

SEQ ID NO: 1895 - RNA, 23 nt, Artificial Sequence
  source: /note="Description of Artificial Sequence: Synthetic oligonucleotide"
uuccaauaaguuuuggucgaugc

SEQ ID NO: 1896 - RNA, 23 nt, Artificial Sequence
  source: /note="Description of Artificial Sequence: Synthetic oligonucleotide"
uuuucaaaguaggcuucucgucu

SEQ ID NO: 1897 - RNA, 23 nt, Artificial Sequence
  source: /note="Description of Artificial Sequence: Synthetic oligonucleotide"
uuagcaucaccuagaucacuccc

SEQ ID NO: 1898 - RNA, 23 nt, Artificial Sequence
  source: /note="Description of Artificial Sequence: Synthetic oligonucleotide"
uugacaguuucuaaagacauggu

SEQ ID NO: 1899 - RNA, 23 nt, Artificial Sequence
  source: /note="Description of Artificial Sequence: Synthetic oligonucleotide"
uucugacaguuucuaaagacaug

SEQ ID NO: 1900 - RNA, 23 nt, Artificial Sequence
  source: /note="Description of Artificial Sequence: Synthetic oligonucleotide"
uuuguuugcaaaccgcuaaaagu

SEQ ID NO: 1901 - RNA, 23 nt, Artificial Sequence
  source: /note="Description of Artificial Sequence: Synthetic oligonucleotide"
uucauuuuguuugcaaaccgcua

SEQ ID NO: 1902 - RNA, 23 nt, Artificial Sequence
  source: /note="Description of Artificial Sequence: Synthetic oligonucleotide"
uugucuuuaauugcugaaugccu

SEQ ID NO: 1903 - RNA, 23 nt, Artificial Sequence
  source: /note="Description of Artificial Sequence: Synthetic oligonucleotide"
ucuccaauaaguuuuggucgaug

SEQ ID NO: 1904 - RNA, 23 nt, Artificial Sequence
  source: /note="Description of Artificial Sequence: Synthetic oligonucleotide"
uuguuucucguggaagauggacu

SEQ ID NO: 1905 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ucuugutucucguggaagaugga

SEQ ID NO: 1906 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucuugtuucucguggaagaugg

SEQ ID NO: 1907 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uauauutccagaaggcugcugua

SEQ ID NO: 1908 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uaaauatagaauaaccuuccugu

SEQ ID NO: 1909 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuccaataaguuuuggucgaugc

SEQ ID NO: 1910 - RNA, 23 nt, Artificial Sequence
  source: /note="Description of Artificial Sequence: Synthetic oligonucleotide"
uuuucaaaguaggcuucucgucu

SEQ ID NO: 1911 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuagcatcaccuagaucacuccc

SEQ ID NO: 1912 - RNA, 23 nt, Artificial Sequence
  source: /note="Description of Artificial Sequence: Synthetic oligonucleotide"
uugacaguuucuaaagacauggu

SEQ ID NO: 1913 - RNA, 23 nt, Artificial Sequence
  source: /note="Description of Artificial Sequence: Synthetic oligonucleotide"
uucugacaguuucuaaagacaug

SEQ ID NO: 1914 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uuuguutgcaaaccgcuaaaagu

SEQ ID NO: 1915 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uucauutuguuugcaaaccgcua

SEQ ID NO: 1916 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
uugucutuaauugcugaaugccu

SEQ ID NO: 1917 - RNA, 23 nt, Artificial Sequence
  source: /note="Description of Artificial Sequence: Synthetic oligonucleotide"
ucuccaauaaguuuuggucgaug

SEQ ID NO: 1918 - DNA, 6036 bp, Homo sapiens
gtgggggccgttggctccagacaaataaacatggagtccatcttccacgagaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 1919 - DNA, 6036 bp, Homo sapiens
tagaaaagcaaacattatctttatttaataatctttgatatttaaaatacaactcattgaacatccacactaacaacagaatcctgtgttcaacagtgctttggaagcccggcttttctaacgaccagacaggaaggcctgtgtgtgtaataacagcaaatgaacttaacgagggagcacacacagaagggctgcagggctgggtcctgagcaagcggcactgccacagtgcacttgtatcatggccaaacaacaatgctttttgtttcagatattttctgtacttgaatttcaaatatttatacagaacagtaatttttaaaaagttattcctaatagcccagtgttgtaaaaattagataatcacatttaaaaatgtatgttttcctctttcaaaaaaaaaaaaagcattaaaaaaattcagaaaacattccttgaactatgcaagagacaattgagagcttcctaaatgcatcaggaatatccatttatattttactaatgtttctcattgctttgtctatgaatccacaggcttaaaatgttttttgatatgctattaaacatgccaattacgacaaatttagaagttacgttattagcactaattcttaaaatgccagaccacttggaaaaaataataatagcaaagattttcttcaaattaaaaaacaaaatcaaaattctagaatttaccaacgatgtcaataatcttcactcatgaaagcaaattagaacaaaaatatttttattatgtttaagactaaaaaaatacaaagccaggtcattttttaaagcaaaaagatgctggttataaaggggccagaaataaaagaaagtttttattttgaatatgaaaaataaagttatttacattgctgacatgattagttgatccaatctggtagttcttaattagggtcacatatatatccatacttaaggactcgatacaacaaacaattcactttgaaaacagtggcccaaggccgggtgtggtggcctgcacctgtaatcccagcactttgggaggccaaggcaggcagatcacctgaggtcaggagtttgagaccagcctaacatggtaaaagcccgtctctactaaaaaaaacaaatattcgccaggtgtagtggcaggtgcctgtaatcccaggtacttgggaggctgaggcaggagaatcgcttgaacccaggaggtggaggttgcagtgagccaacatcgtgtcattgtactccagcctgggcagcagagctagactccgtctcagaaaaaaaaaaaaagaaagaaagaaagaaagaaaaagaaaatagcggcccaacgcctcttcgtttccggattaaaaaaaaacaaacaaacctttaagatggagttttactcttgttgcccaggctagagtgcaatggcacgatctcagctcactgcaacctccacctcctgggtttaaacgattctcctgcctcagcctcccaagtaactgggattacaggtgcccgccaccatacctggcttaagttttgtatttttagtagagatggggtttcaccatgttggccaggctggtctcaaactccggacttcaggtgatccacctgcctcagcctcccaaagtgttgggattacaggcgtgagccactgcccccgactgggataaagtttttaataggaagtcatatatatatacatatatatatacacacatatatatatatatatatatatttttttttttcagaaacagtgtctcactctgttgggcaggctggaatgcagtggtgagcccttggcactctgcaacctctgcctcctaggctcatgcgattcttagcctcctgagtagctgggattacaagtgtgtgcaaccacgcccggctaatttttgtatttttagtagaaacgaggtttcaccatgttgcccagactggtcttgaactcctggcctgaagtgattcgcccacctcagcctccagaactgctgggattacaggcgtgagccactgcacccagccgggagatcatcaatattaactattgaatcctcgtaagaatttaaaacatcaagatttatttttctacttaagattttaaaattatcatattttgattatgcactgaatctattttttatctgtacaggtccaatgggccggttttaagaatttagtagctcttggcactagcatgattttttttttttttttgagacagagtctcactctgtcgcccagtctggagtacagtggcaccatcttggctcactgcatcctctgtcgccagggttcaagcaattctcctgcctcagactcccaggtagctgggattacaggcacctgccaccgcgcccagctaatttttgtagtttttagtacagatggggtttcaccattttggccaagctggtctcgaactcccgacctcgtgatccacccacttcggcctcccaaaatgctgggattacaggcgtgagctaccacgcccagccgccactagcatgattttaaaaatagtatcaaaaattcagacaatcaaaatgtgatttaggctctgactgaaataaaatttattttattcaacttaatattaaacaatatggactactggtagttttgtctgcaatgatactcaactggttttgagtttttttcctcatttactttggcatcatgaataaagttaagaaaaatcaagttttaaggacaaaaaaaaaaagcaccaccttaaataaaatattctgtgaattgtaaattatttggccaagatcctagtatagagtttacctgcagcagccttttcaaacagtttatattactgaaatatttacatgattaccgtaaaaaacatagattgatggttttagatcagagattaactattctgaattttaaaaacataaattactcattaaatccatgacatctgaaaatatgaaagtggtatttccaaggcttaaacttctactagcatcaccactgtacatacttgatcccagtaatacaaattatacattagaaaaatgataccaatagtttaaatattaaacattaagatgttcccaattagtaaaacaaaatggaaatctttaatacacttcttagcaggacagttcttgtgaatttagttgttcctgactttcttgcaggtggtttacagtaaatggcagtacctgatgtataaactatagctttgaataatttttaacttttttgatactatggttacttgcactggcatcttttcatactggccaatcaattaagaaatggaatctaaacagtcaattaaatttaagccaaccccaccaagatgacagttcactagtgcttctggatctgcctgctaaatgtaacaatttcacaacaaactacacaaacacattcaaacgcatccagtgtgtgctcagctctgctttaaaaactctctagctggccaggcgcagtggctcatgcctgtaatcccaacactttgggaggccaaggcaggcggatcacctgaggtcaggagttcgagaccagcctggccaaacatgatgaaaccgcgtctctaccaaaaatacaaaaatctgccgggtgtggtggtgggcgcctgtaatcccagctactctggaggctgaggcaggagaattgcttgaacccgggaggtggaagttgtagtgagccgagatcatgccactgccctccagcctgggagacatagcaagactccgtctcaaaaaaaaacaaaaacaaaaacaaaaactctctaggaactaaaagtcaaacatgccatattttcttaagtgctttaactagggtatatatgaactttataaactctaaagttaaaactttaaaatgcatattggttttctcatttttatattaggtagctcatcaattcaagtgtatgaaaagtttaatgtaacttttcaatggaaaaaggtaatgaacaaatatccatggaaaatatgacaaacacactggtaataattaacataaatgttcagtcttaaaatatttagctttttaaatcttgagggagtagtactaaactccaacatcccttgcagttttaaagttttataattcttctgaaacatttttaactattaaaagaaactttagattttaaaataaagctatccttttgtgtaagggaaacttcagaaaactgattggcacaaaataatgacttaaaaaatctgttatatcgaagaaaaagctattttataatcataaataaaagatattttttcttctcttttcagttagttagcaataaatcctagatcaaaaaactttccctgataaaatgtgtgcagccacacaccaggagggcaatataccatattataattttcgaagttgtcagctgaaatttcttggattttagcttatgaacaattcaacattcaaaagagcttcaaaaggagatggagaatgagggatagggaacactgaaactaaaacatcaatttcagagacatggttttcaccaaaatgatactatcctattgacccagcaagaaactctctgtacatctcaattaaagagaatatttatcaaaactatggactttcttatttatagatccactaagtactgtgacttccattgttcttaagctatctaaacatgatgcaagtgtcaaatcacagtataaatttaaacatattttcattagtaaattattttcatgttccagatcaccatctttgacaagctatacctactaaaagatgtgaagcagacacctacattccatgactcaactgtaaagagaacacaaagctccagtcataggagaaaaaataaaataaaactgctattaaaattgaaggccaaatttcatgtatcatacattcatggtgggtacgtatgtttagtcttctaacagaaggagacttgcctgcatactatgcttctcctagttttctcaattggagaagaaaggaaaaaataaggcgcaggaagaaggggttgcaacaaagctgtaaggttttgatataagtgaaaagacattcataaagcatctgggaaagcacatgctcacacattttaaaaaatgctcatttattctcaagtacttgtgcaaggctgatttcagagtttaggaacgcaccagtcatgaaataatgatcccatcgtagggcttaaaacgctaaacctcagaaaagattaccatctttcaaaagaattgtgggaaaataatgaaaaccaggtagcagaaaagttgtgatcagagaaaacaacacaagaaaacactggagcacacggtatacagttgaagggagaactgttcatccttctagaaccattactattatcaacatcaggaaagtagagatactttcctgaaaggttaatttggttaataagaaatgaaagccactattacatgatgtgagccaacttacctacaagacagaaaaagaaaacaaactatatggaaaaagcctgaggcgagagctaattagctagtctgcaaaaagatccaagaaaaatgccctaactttagacatgttacatattgcacactcaaaaaagaaaaagaaacatttagaaaactattttaaatgtctttaattgctgaatgcctctttggctaatatttggaagatcattatttagtcctacaaccgacgcattgttccactttcccatcattttgtttgcaaaccgctaaaagtcttatttcctcatctctttgacacattaccaaagtggaccctatgctgtaatcacacaggataatgttggaaagtatgaatatctaaattattttttaaaggtattatttttttccttctgttttcaaatcatttctgacagtttctaaagacatggtcacagctgcctgaagcatgtcttcttcactcatagcatcacctagatcactcccaagtgctcctgaactggtggctggcctttcacatggatgtgaactctgtcctgataggtccccctgctgctgctgctgctgctgctgttgctgcttttgctgctgttttctcgtggaagatggactccatgtttatttgtctggagccaacggcccccac

SEQ ID NO: 1920 - DNA, 132 bp, Unknown
  source: /note="Description of Unknown: ATXN3 repeat sequence"
  misc_feature (1)..(132): /note="This sequence may encompass 12-44 'cag' repeating units"
cagcagcagcagcagcagcagcagcagcagcagcagcagcagcagcagcagcagcagcagcagcagcagcagcagcagcagcagcagcagcagcagcagcagcagcagcagcagcagcagcagcagcagcag

SEQ ID NO: 1921 - DNA, 258 bp, Unknown
  source: /note="Description of Unknown: ATXN3 repeat sequence"
  misc_feature (1)..(258): /note="This sequence may encompass 52-86 'cag' repeating units"
cagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcag

SEQ ID NO: 1922 - DNA, 228 bp, Unknown
  source: /note="Description of Unknown: ATXN3 repeat sequence"
cagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcag

SEQ ID NO: 1923 - DNA, 252 bp, Unknown
  source: /note="Description of Unknown: ATXN3 repeat sequence"
cagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcag

SEQ ID NO: 1924 - DNA, 444 bp, Unknown
  source: /note="Description of Unknown: ATXN3 repeat sequence"
cagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcag

SEQ ID NO: 1925 - RNA, 21 nt, Artificial Sequence
  source: /note="Description of Artificial Sequence: Synthetic oligonucleotide"
aaacugucagaaaugauuuga

SEQ ID NO: 1926 - RNA, 21 nt, Artificial Sequence
  source: /note="Description of Artificial Sequence: Synthetic oligonucleotide"
aacugucagaaaugauuugaa

SEQ ID NO: 1927 - RNA, 21 nt, Artificial Sequence
  source: /note="Description of Artificial Sequence: Synthetic oligonucleotide"
acugucagaaaugauuugaaa

SEQ ID NO: 1928 - RNA, 21 nt, Artificial Sequence
  source: /note="Description of Artificial Sequence: Synthetic oligonucleotide"
uagaaacugucagaaaugaua

SEQ ID NO: 1929 - RNA, 21 nt, Artificial Sequence
  source: /note="Description of Artificial Sequence: Synthetic oligonucleotide"
caaagagaugaggaaauaaga

SEQ ID NO: 1930 - RNA, 21 nt, Artificial Sequence
  source: /note="Description of Artificial Sequence: Synthetic oligonucleotide"
cgguuugcaaacaaaaugaua

SEQ ID NO: 1931 - RNA, 21 nt, Artificial Sequence
  source: /note="Description of Artificial Sequence: Synthetic oligonucleotide"
gaggcauucagcaauuaaaga

SEQ ID NO: 1932 - RNA, 21 nt, Artificial Sequence
  source: /note="Description of Artificial Sequence: Synthetic oligonucleotide"
aggcauucagcaauuaaagaa

SEQ ID NO: 1933 - RNA, 21 nt, Artificial Sequence
  source: /note="Description of Artificial Sequence: Synthetic oligonucleotide"
uuuuucuuggaucuuuuugca

SEQ ID NO: 1934 - RNA, 21 nt, Artificial Sequence
  source: /note="Description of Artificial Sequence: Synthetic oligonucleotide"
ggcuuucauuucuuauuaaca

SEQ ID NO: 1935 - RNA, 21 nt, Artificial Sequence
  source: /note="Description of Artificial Sequence: Synthetic oligonucleotide"
uaaccaaauuaaccuuucaga

SEQ ID NO: 1936 - RNA, 21 nt, Artificial Sequence
  source: /note="Description of Artificial Sequence: Synthetic oligonucleotide"
gcuccaguguuuucuugugua

SEQ ID NO: 1937 - RNA, 21 nt, Artificial Sequence
  source: /note="Description of Artificial Sequence: Synthetic oligonucleotide"
cuccaguguuuucuuguguua

SEQ ID NO: 1938 - RNA, 21 nt, Artificial Sequence
  source: /note="Description of Artificial Sequence: Synthetic oligonucleotide"
ucucugaucacaacuuuucua

SEQ ID NO: 1939 - RNA, 21 nt, Artificial Sequence
  source: /note="Description of Artificial Sequence: Synthetic oligonucleotide"
cucugaucacaacuuuucuga

SEQ ID NO: 1940 - RNA, 21 nt, Artificial Sequence
  source: /note="Description of Artificial Sequence: Synthetic oligonucleotide"
ucugaucacaacuuuucugca

SEQ ID NO: 1941 - RNA, 21 nt, Artificial Sequence
  source: /note="Description of Artificial Sequence: Synthetic oligonucleotide"
cugguuuucauuauuuuccca

SEQ ID NO: 1942 - RNA, 21 nt, Artificial Sequence
  source: /note="Description of Artificial Sequence: Synthetic oligonucleotide"
uuuucccacaauucuuuugaa

SEQ ID NO: 1943 - RNA, 21 nt, Artificial Sequence
  source: /note="Description of Artificial Sequence: Synthetic oligonucleotide"
uuucccacaauucuuuugaaa

SEQ ID NO: 1944 - RNA, 21 nt, Artificial Sequence
  source: /note="Description of Artificial Sequence: Synthetic oligonucleotide"
cuaccugguuuucauuauuua

SEQ ID NO: 1945 - RNA, 21 nt, Artificial Sequence
  source: /note="Description of Artificial Sequence: Synthetic oligonucleotide"
accugguuuucauuauuuuca

SEQ ID NO: 1946 - RNA, 21 nt, Artificial Sequence
  source: /note="Description of Artificial Sequence: Synthetic oligonucleotide"
cacaauucuuuugaaagauga

SEQ ID NO: 1947 - RNA, 21 nt, Artificial Sequence
  source: /note="Description of Artificial Sequence: Synthetic oligonucleotide"
uuuugaaagaugguaaucuua

SEQ ID NO: 1948 - RNA, 21 nt, Artificial Sequence
  source: /note="Description of Artificial Sequence: Synthetic oligonucleotide"
gaaagaugguaaucuuuucua

SEQ ID NO: 1949 - RNA, 21 nt, Artificial Sequence
  source: /note="Description of Artificial Sequence: Synthetic oligonucleotide"
uuccuaaacucugaaaucaga

SEQ ID NO: 1950 - RNA, 21 nt, Artificial Sequence
  source: /note="Description of Artificial Sequence: Synthetic oligonucleotide"
caaguacuugagaauaaauga

SEQ ID NO: 1951 - RNA, 21 nt, Artificial Sequence
  source: /note="Description of Artificial Sequence: Synthetic oligonucleotide"
cuuucccagaugcuuuaugaa

SEQ ID NO: 1952 - RNA, 21 nt, Artificial Sequence
  source: /note="Description of Artificial Sequence: Synthetic oligonucleotide"
aaguacuugagaauaaaugaa

SEQ ID NO: 1953 - RNA, 21 nt, Artificial Sequence
  source: /note="Description of Artificial Sequence: Synthetic oligonucleotide"
uuucccagaugcuuuaugaaa

SEQ ID NO: 1954 - RNA, 21 nt, Artificial Sequence
  source: /note="Description of Artificial Sequence: Synthetic oligonucleotide"
caaaaccuuacagcuuuguua

SEQ ID NO: 1955 - RNA, 21 nt, Artificial Sequence
  source: /note="Description of Artificial Sequence: Synthetic oligonucleotide"
aaaaccuuacagcuuuguuga

SEQ ID NO: 1956 - RNA, 21 nt, Artificial Sequence
  source: /note="Description of Artificial Sequence: Synthetic oligonucleotide"
uccaucuuccacgagaaacaa

SEQ ID NO: 1957 - RNA, 21 nt, Artificial Sequence
  source: /note="Description of Artificial Sequence: Synthetic oligonucleotide"
caucuuccacgagaaacaaga

SEQ ID NO: 1958 - RNA, 21 nt, Artificial Sequence
  source: /note="Description of Artificial Sequence: Synthetic oligonucleotide"
aucuuccacgagaaacaagaa

SEQ ID NO: 1959 - RNA, 21 nt, Artificial Sequence
  source: /note="Description of Artificial Sequence: Synthetic oligonucleotide"
cagcagccuucuggaaauaua

SEQ ID NO: 1960 - RNA, 21 nt, Artificial Sequence
  source: /note="Description of Artificial Sequence: Synthetic oligonucleotide"
aggaagguuauucuauauuua

SEQ ID NO: 1961 - RNA, 21 nt, Artificial Sequence
  source: /note="Description of Artificial Sequence: Synthetic oligonucleotide"
aucgaccaaaacuuauuggaa

SEQ ID NO: 1962 - RNA, 21 nt, Artificial Sequence
  source: /note="Description of Artificial Sequence: Synthetic oligonucleotide"
acgagaagccuacuuugaaaa

SEQ ID NO: 1963 - RNA, 21 nt, Artificial Sequence
  source: /note="Description of Artificial Sequence: Synthetic oligonucleotide"
gagugaucuaggugaugcuaa

SEQ ID NO: 1964 - RNA, 21 nt, Artificial Sequence
  source: /note="Description of Artificial Sequence: Synthetic oligonucleotide"
caugucuuuagaaacugucaa

SEQ ID NO: 1965 - RNA, 21 nt, Artificial Sequence
  source: /note="Description of Artificial Sequence: Synthetic oligonucleotide"
ugucuuuagaaacugucagaa

SEQ ID NO: 1966 - RNA, 21 nt, Artificial Sequence
  source: /note="Description of Artificial Sequence: Synthetic oligonucleotide"
uuuuagcgguuugcaaacaaa

SEQ ID NO: 1967 - RNA, 21 nt, Artificial Sequence
  source: /note="Description of Artificial Sequence: Synthetic oligonucleotide"
gcgguuugcaaacaaaaugaa

SEQ ID NO: 1968 - RNA, 21 nt, Artificial Sequence
  source: /note="Description of Artificial Sequence: Synthetic oligonucleotide"
gcauucagcaauuaaagacaa

SEQ ID NO: 1969 - RNA, 21 nt, Artificial Sequence
  source: /note="Description of Artificial Sequence: Synthetic oligonucleotide"
ucgaccaaaacuuauuggaga

SEQ ID NO: 1970 - RNA, 21 nt, Artificial Sequence
  source: /note="Description of Artificial Sequence: Synthetic oligonucleotide"
uccaucuuccacgagaaacaa

SEQ ID NO: 1971 - RNA, 21 nt, Artificial Sequence
  source: /note="Description of Artificial Sequence: Synthetic oligonucleotide"
caucuuccacgagaaacaaga

SEQ ID NO: 1972 - RNA, 21 nt, Artificial Sequence
  source: /note="Description of Artificial Sequence: Synthetic oligonucleotide"
aucuuccacgagaaacaagaa

SEQ ID NO: 1973 - RNA, 21 nt, Artificial Sequence
  source: /note="Description of Artificial Sequence: Synthetic oligonucleotide"
cagcagccuucuggaaauaua

SEQ ID NO: 1974 - RNA, 21 nt, Artificial Sequence
  source: /note="Description of Artificial Sequence: Synthetic oligonucleotide"
aggaagguuauucuauauuua

SEQ ID NO: 1975 - RNA, 21 nt, Artificial Sequence
  source: /note="Description of Artificial Sequence: Synthetic oligonucleotide"
aucgaccaaaacuuauuggaa

SEQ ID NO: 1976 - RNA, 21 nt, Artificial Sequence
  source: /note="Description of Artificial Sequence: Synthetic oligonucleotide"
acgagaagccuacuuugaaaa

SEQ ID NO: 1977 - RNA, 21 nt, Artificial Sequence
  source: /note="Description of Artificial Sequence: Synthetic oligonucleotide"
gagugaucuaggugaugcuaa

SEQ ID NO: 1978 - RNA, 21 nt, Artificial Sequence
  source: /note="Description of Artificial Sequence: Synthetic oligonucleotide"
caugucuuuagaaacugucaa

SEQ ID NO: 1979 - RNA, 21 nt, Artificial Sequence
  source: /note="Description of Artificial Sequence: Synthetic oligonucleotide"
ugucuuuagaaacugucagaa

SEQ ID NO: 1980 - RNA, 21 nt, Artificial Sequence
  source: /note="Description of Artificial Sequence: Synthetic oligonucleotide"
uuuuagcgguuugcaaacaaa

SEQ ID NO: 1981 - RNA, 21 nt, Artificial Sequence
  source: /note="Description of Artificial Sequence: Synthetic oligonucleotide"
gcgguuugcaaacaaaaugaa

SEQ ID NO: 1982 - RNA, 21 nt, Artificial Sequence
  source: /note="Description of Artificial Sequence: Synthetic oligonucleotide"
gcauucagcaauuaaagacaa

SEQ ID NO: 1983 - RNA, 23 nt, Artificial Sequence
  source: /note="Description of Artificial Sequence: Synthetic oligonucleotide"
ucaaaucauuucugacaguuucu

SEQ ID NO: 1984 - RNA, 23 nt, Artificial Sequence
  source: /note="Description of Artificial Sequence: Synthetic oligonucleotide"
uucaaaucauuucugacaguuuc

SEQ ID NO: 1985 - RNA, 23 nt, Artificial Sequence
  source: /note="Description of Artificial Sequence: Synthetic oligonucleotide"
uuucaaaucauuucugacaguuu

SEQ ID NO: 1986 - RNA, 23 nt, Artificial Sequence
  source: /note="Description of Artificial Sequence: Synthetic oligonucleotide"
uaucauuucugacaguuucuaaa

SEQ ID NO: 1987 - RNA, 23 nt, Artificial Sequence
  source: /note="Description of Artificial Sequence: Synthetic oligonucleotide"
ucuuauuuccucaucucuuugac

SEQ ID NO: 1988 - RNA, 23 nt, Artificial Sequence
  source: /note="Description of Artificial Sequence: Synthetic oligonucleotide"
uaucauuuuguuugcaaaccgcu

SEQ ID NO: 1989 - RNA, 23 nt, Artificial Sequence
  source: /note="Description of Artificial Sequence: Synthetic oligonucleotide"
ucuuuaauugcugaaugccucuu

SEQ ID NO: 1990 - RNA, 23 nt, Artificial Sequence
  source: /note="Description of Artificial Sequence: Synthetic oligonucleotide"
uucuuuaauugcugaaugccucu

SEQ ID NO: 1991 - RNA, 23 nt, Artificial Sequence
  source: /note="Description of Artificial Sequence: Synthetic oligonucleotide"
ugcaaaaagauccaagaaaaaug

SEQ ID NO: 1992 - RNA, 23 nt, Artificial Sequence
  source: /note="Description of Artificial Sequence: Synthetic oligonucleotide"
uguuaauaagaaaugaaagccac

SEQ ID NO: 1993 - RNA, 23 nt, Artificial Sequence
  source: /note="Description of Artificial Sequence: Synthetic oligonucleotide"
ucugaaagguuaauuugguuaau

SEQ ID NO: 1994 - RNA, 23 nt, Artificial Sequence
  source: /note="Description of Artificial Sequence: Synthetic oligonucleotide"
uacacaagaaaacacuggagcac

SEQ ID NO: 1995 - RNA, 23 nt, Artificial Sequence
  source: /note="Description of Artificial Sequence: Synthetic oligonucleotide"
uaacacaagaaaacacuggagca

SEQ ID NO: 1996 - RNA, 23 nt, Artificial Sequence
  source: /note="Description of Artificial Sequence: Synthetic oligonucleotide"
uagaaaaguugugaucagagaaa

SEQ ID NO: 1997 - RNA, 23 nt, Artificial Sequence
  source: /note="Description of Artificial Sequence: Synthetic oligonucleotide"
ucagaaaaguugugaucagagaa

SEQ ID NO: 1998 - RNA, 23 nt, Artificial Sequence
  source: /note="Description of Artificial Sequence: Synthetic oligonucleotide"
ugcagaaaaguugugaucagaga

SEQ ID NO: 1999 - RNA, 23 nt, Artificial Sequence
  source: /note="Description of Artificial Sequence: Synthetic oligonucleotide"
ugggaaaauaaugaaaaccaggu

SEQ ID NO: 2000 - RNA, 23 nt, Artificial Sequence
  source: /note="Description of Artificial Sequence: Synthetic oligonucleotide"
uucaaaagaauugugggaaaaua

SEQ ID NO: 2001 - RNA, 23 nt, Artificial Sequence
  source: /note="Description of Artificial Sequence: Synthetic oligonucleotide"
uuucaaaagaauugugggaaaau

SEQ ID NO: 2002 - RNA, 23 nt, Artificial Sequence
  source: /note="Description of Artificial Sequence: Synthetic oligonucleotide"
uaaauaaugaaaaccagguagca

SEQ ID NO: 2003 - RNA, 23 nt, Artificial Sequence
  source: /note="Description of Artificial Sequence: Synthetic oligonucleotide"
ugaaaauaaugaaaaccagguag

SEQ ID NO: 2004 - RNA, 23 nt, Artificial Sequence
  source: /note="Description of Artificial Sequence: Synthetic oligonucleotide"
ucaucuuucaaaagaauuguggg

SEQ ID NO: 2005 - RNA, 23 nt, Artificial Sequence
  source: /note="Description of Artificial Sequence: Synthetic oligonucleotide"
uaagauuaccaucuuucaaaaga

SEQ ID NO: 2006 - RNA, 23 nt, Artificial Sequence
  source: /note="Description of Artificial Sequence: Synthetic oligonucleotide"
uagaaaagauuaccaucuuucaa

SEQ ID NO: 2007 - RNA, 23 nt, Artificial Sequence
  source: /note="Description of Artificial Sequence: Synthetic oligonucleotide"
ucugauuucagaguuuaggaacg

SEQ ID NO: 2008 - RNA, 23 nt, Artificial Sequence
  source: /note="Description of Artificial Sequence: Synthetic oligonucleotide"
ucauuuauucucaaguacuugug

SEQ ID NO: 2009 - RNA, 23 nt, Artificial Sequence
  source: /note="Description of Artificial Sequence: Synthetic oligonucleotide"
uucauaaagcaucugggaaagca

SEQ ID NO: 2010 - RNA, 23 nt, Artificial Sequence
  source: /note="Description of Artificial Sequence: Synthetic oligonucleotide"
uucauuuauucucaaguacuugu

SEQ ID NO: 2011 - RNA, 23 nt, Artificial Sequence
  source: /note="Description of Artificial Sequence: Synthetic oligonucleotide"
uuucauaaagcaucugggaaagc

SEQ ID NO: 2012 - RNA, 23 nt, Artificial Sequence
  source: /note="Description of Artificial Sequence: Synthetic oligonucleotide"
uaacaaagcuguaagguuuugau

SEQ ID NO: 2013 - RNA, 23 nt, Artificial Sequence
  source: /note="Description of Artificial Sequence: Synthetic oligonucleotide"
ucaacaaagcuguaagguuuuga

SEQ ID NO: 2014 - RNA, 23 nt, Artificial Sequence
  source: /note="Description of Artificial Sequence: Synthetic oligonucleotide"
uuguuucucguggaagauggacu

SEQ ID NO: 2015 - RNA, 23 nt, Artificial Sequence
  source: /note="Description of Artificial Sequence: Synthetic oligonucleotide"
ucuuguuucucguggaagaugga

SEQ ID NO: 2016 - RNA, 23 nt, Artificial Sequence
  source: /note="Description of Artificial Sequence: Synthetic oligonucleotide"
uucuuguuucucguggaagaugg

SEQ ID NO: 2017 - RNA, 23 nt, Artificial Sequence
  source: /note="Description of Artificial Sequence: Synthetic oligonucleotide"
uauauuuccagaaggcugcugua

SEQ ID NO: 2018 - RNA, 23 nt, Artificial Sequence
  source: /note="Description of Artificial Sequence: Synthetic oligonucleotide"
uaaauauagaauaaccuuccugu

SEQ ID NO: 2019 - RNA, 23 nt, Artificial Sequence
  source: /note="Description of Artificial Sequence: Synthetic oligonucleotide"
uuccaauaaguuuuggucgaugc

SEQ ID NO: 2020 - RNA, 23 nt, Artificial Sequence
  source: /note="Description of Artificial Sequence: Synthetic oligonucleotide"
uuuucaaaguaggcuucucgucu

SEQ ID NO: 2021 - RNA, 23 nt, Artificial Sequence
  source: /note="Description of Artificial Sequence: Synthetic oligonucleotide"
uuagcaucaccuagaucacuccc

SEQ ID NO: 2022 - RNA, 23 nt, Artificial Sequence
  source: /note="Description of Artificial Sequence: Synthetic oligonucleotide"
uugacaguuucuaaagacauggu

SEQ ID NO: 2023 - RNA, 23 nt, Artificial Sequence
  source: /note="Description of Artificial Sequence: Synthetic oligonucleotide"
uucugacaguuucuaaagacaug

SEQ ID NO: 2024 - RNA, 23 nt, Artificial Sequence
  source: /note="Description of Artificial Sequence: Synthetic oligonucleotide"
uuuguuugcaaaccgcuaaaagu

SEQ ID NO: 2025 - RNA, 23 nt, Artificial Sequence
  source: /note="Description of Artificial Sequence: Synthetic oligonucleotide"
uucauuuuguuugcaaaccgcua

SEQ ID NO: 2026 - RNA, 23 nt, Artificial Sequence
  source: /note="Description of Artificial Sequence: Synthetic oligonucleotide"
uugucuuuaauugcugaaugccu

SEQ ID NO: 2027 - RNA, 23 nt, Artificial Sequence
  source: /note="Description of Artificial Sequence: Synthetic oligonucleotide"
ucuccaauaaguuuuggucgaug

SEQ ID NO: 2028 - RNA, 23 nt, Artificial Sequence
  source: /note="Description of Artificial Sequence: Synthetic oligonucleotide"
uuguuucucguggaagauggacu

SEQ ID NO: 2029 - RNA, 23 nt, Artificial Sequence
  source: /note="Description of Artificial Sequence: Synthetic oligonucleotide"
ucuuguuucucguggaagaugga

SEQ ID NO: 2030 - RNA, 23 nt, Artificial Sequence
  source: /note="Description of Artificial Sequence: Synthetic oligonucleotide"
uucuuguuucucguggaagaugg

SEQ ID NO: 2031 - RNA, 23 nt, Artificial Sequence
  source: /note="Description of Artificial Sequence: Synthetic oligonucleotide"
uauauuuccagaaggcugcugua

SEQ ID NO: 2032 - RNA, 23 nt, Artificial Sequence
  source: /note="Description of Artificial Sequence: Synthetic oligonucleotide"
uaaauauagaauaaccuuccugu

SEQ ID NO: 2033 - RNA, 23 nt, Artificial Sequence
  source: /note="Description of Artificial Sequence: Synthetic oligonucleotide"
uuccaauaaguuuuggucgaugc

SEQ ID NO: 2034 - RNA, 23 nt, Artificial Sequence
  source: /note="Description of Artificial Sequence: Synthetic oligonucleotide"
uuuucaaaguaggcuucucgucu

SEQ ID NO: 2035 - RNA, 23 nt, Artificial Sequence
  source: /note="Description of Artificial Sequence: Synthetic oligonucleotide"
uuagcaucaccuagaucacuccc

SEQ ID NO: 2036 - RNA, 23 nt, Artificial Sequence
  source: /note="Description of Artificial Sequence: Synthetic oligonucleotide"
uugacaguuucuaaagacauggu

SEQ ID NO: 2037 - RNA, 23 nt, Artificial Sequence
  source: /note="Description of Artificial Sequence: Synthetic oligonucleotide"
uucugacaguuucuaaagacaug

SEQ ID NO: 2038 - RNA, 23 nt, Artificial Sequence
  source: /note="Description of Artificial Sequence: Synthetic oligonucleotide"
uuuguuugcaaaccgcuaaaagu

SEQ ID NO: 2039 - RNA, 23 nt, Artificial Sequence
  source: /note="Description of Artificial Sequence: Synthetic oligonucleotide"
uucauuuuguuugcaaaccgcua

SEQ ID NO: 2040 - RNA, 23 nt, Artificial Sequence
  source: /note="Description of Artificial Sequence: Synthetic oligonucleotide"
uugucuuuaauugcugaaugccu

We claim:

1. A double-stranded ribonucleic acid (dsRNA) agent for inhibiting expression of ATXN3, wherein the dsRNA agent comprises a sense strand and an antisense strand forming a double-stranded region, wherein the antisense strand comprises at least 15 contiguous nucleotides differing by no more than 3 nucleotides from a nucleotide sequence of an antisense sequence set forth as SEQ ID NO: 1898, 1862, or 1912, and the sense strand comprises at least 15 contiguous nucleotides differing by no more than 3 nucleotides from a nucleotide sequence of a sense sequence set forth as SEQ ID NO: 1839, 1803, or 1853.

2. The dsRNA agent of claim 1, wherein
(a) the antisense strand comprises a nucleotide sequence set forth as SEQ ID NO: 1898, and the sense strand comprises a nucleotide sequence set forth as SEQ ID NO: 1839;
(b) the antisense strand comprises a nucleotide sequence set forth as SEQ ID NO: 1862, and the sense strand comprises a nucleotide sequence set forth as SEQ ID NO: 1803; or
(c) the antisense strand comprises a nucleotide sequence set forth as SEQ ID NO: 1912, and the sense strand comprises a nucleotide sequence set forth as SEQ ID NO: 1853.

3. The dsRNA agent of claim 1, wherein (a) the sense strand comprises the sequence and all of the modifications of SEQ ID NO: 1662 and the antisense strand comprises the sequence and all of the modifications of SEQ ID NO: 1721;
(b) the sense strand comprises the sequence and all of the modifications of SEQ ID NO: 1964 and the antisense strand comprises the sequence and all of the modifications of SEQ ID NO: 2022;
(c) the sense strand comprises the sequence and all of the modifications of SEQ ID NO: 1626 and the antisense strand comprises the sequence and all of the modifications of SEQ ID NO: 1685;
(d) the sense strand comprises the sequence and all of the modifications of SEQ ID NO: 1928 and the antisense strand comprises the sequence and all of the modifications of SEQ ID NO: 1986; or
(e) the sense strand comprises the sequence and all of the modifications of SEQ ID NO: 1676 and the antisense strand comprises the sequence and all of the modifications of SEQ ID NO: 1735.

4. The dsRNA agent of claim 1, wherein at least one of the sense strand and the antisense strand is conjugated to one or more lipophilic moieties.

5. The dsRNA agent of claim 4, wherein
(a) the lipophilic moiety is conjugated to one or more positions in the double-stranded region of the dsRNA agent;

(b) the lipophilic moiety is conjugated via a linker or carrier;

(c) lipophilicity of the lipophilic moiety, measured by log Kow, exceeds 0;

(d) the one or more lipophilic moieties are conjugated to one or more internal positions on at least one strand;

(e) the one or more lipophilic moieties are conjugated to one or more internal positions on at least one strand via a linker or carrier;

(f) the one or more lipophilic moieties are conjugated to one or more internal positions on at least one strand via a linker or carrier, wherein the internal positions include all positions except the terminal two positions from each end of the at least one strand;

(g) the one or more lipophilic moieties are conjugated to one or more internal positions on at least one strand via a linker or carrier, wherein the internal positions include all positions except the terminal three positions from each end of the at least one strand;

(h) the one or more lipophilic moieties are conjugated to one or more internal positions on at least one strand via a linker or carrier, wherein the internal positions exclude a cleavage site region of the sense strand;

(i) the one or more lipophilic moieties are conjugated to one or more internal positions on at least one strand via a linker or carrier, wherein the internal positions include all positions except positions 9-12, counting from the 5'-end of the sense strand;

(j) the one or more lipophilic moieties are conjugated to one or more internal positions on at least one strand via a linker or carrier, wherein the internal positions include all positions except positions 11-13, counting from the 3'-end of the sense strand;

(k) the one or more lipophilic moieties are conjugated to one or more internal positions on at least one strand via a linker or carrier, wherein the internal positions include all positions except positions 11-13, counting from the 3'-end of the sense strand;

(l) the one or more lipophilic moieties are conjugated to one or more internal positions on at least one strand via a linker or carrier, wherein the internal positions exclude a cleavage site region of the antisense strand;

(m) the one or more lipophilic moieties are conjugated to one or more internal positions on at least one strand via a linker or carrier, wherein the internal positions include all positions except positions 12-14, counting from the 5'-end of the antisense strand;

(n) the one or more lipophilic moieties are conjugated to one or more internal positions on at least one strand via a linker or carrier, wherein the internal positions include all positions except positions 11-13 on the sense strand, counting from the 3'-end, and positions 12-14 on the antisense strand, counting from the 5'-end;

(o) wherein the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand;

(p) wherein the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand;

(q) the lipophilic moiety is conjugated to one or more positions in the double-stranded region of the dsRNA agent, wherein the positions in the double-stranded region exclude a cleavage site region of the sense strand;

(r) wherein the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand;

(s) wherein the lipophilic moiety is conjugated to position 21, position 20, position 15, position 1, or position 7 of the sense strand;

(t) wherein the lipophilic moiety is conjugated to position 21, position 20, or position 15 of the sense strand;

(u) wherein the lipophilic moiety is conjugated to position 20 or position 15 of the sense strand;

(v) wherein the lipophilic moiety is conjugated to position 16 of the antisense strand;

(w) wherein the lipophilic moiety is conjugated to position 6, counting from the 5'-end of the sense strand;

(x) wherein the lipophilic moiety is an aliphatic, alicyclic, or polyalicyclic compound;

(y) wherein the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine;

(z) wherein the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne;

(aa) wherein the lipophilic moiety contains a saturated or unsaturated C6-C18 hydrocarbon chain;

(bb) wherein the lipophilic moiety contains a saturated or unsaturated C16 hydrocarbon chain;

(cc) wherein the lipophilic moiety is conjugated via a carrier that replaces one or more nucleotide(s) in the internal position(s) or the double-stranded region;

(dd) the lipophilic moiety is conjugated via a carrier, wherein the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone;

(ee) wherein the lipophilic moiety is conjugated to the dsRNA agent via a linker containing an ether, thioether, urea, carbonate, amine, amide, maleimide-thioether, disulfide, phosphodiester, sulfonamide linkage, a product of a click reaction, or carbamate;

(ff) wherein the lipophilic moiety is conjugated to a nucleobase, sugar moiety, or internucleosidic linkage; and/or (gg) wherein the lipophilic moiety is conjugated via a bio-cleavable linker selected from the group consisting of DNA, RNA, disulfide, amide, functionalized monosaccharides or oligosaccharides of galactosamine, glucosamine, glucose, galactose, mannose, and combinations thereof.

6. The dsRNA agent of claim 1, wherein (a) the hydrophobicity of the dsRNA agent, measured by the unbound fraction in a plasma protein binding assay of the dsRNA agent, exceeds 0.2;

(b) the hydrophobicity of the dsRNA agent, measured by the unbound fraction in a plasma protein binding assay of the dsRNA agent, exceeds 0.2, and wherein the plasma protein binding assay is an electrophoretic mobility shift assay using human serum albumin protein;

(c) the dsRNA agent comprises at least one phosphorothioate internucleotide linkage; and/or (d) the dsRNA agent comprises at least one phosphorothioate internucleotide linkage, wherein the dsRNA agent comprises 6-8 phosphorothioate internucleotide linkages.

7. The dsRNA agent of claim 1, wherein the dsRNA agent comprises at least one modified nucleotide.

8. The dsRNA agent of claim 7, wherein (a) no more than five of the sense strand nucleotides and not more than five of the nucleotides of the antisense strand are unmodified nucleotides;

(b) all of the nucleotides of the sense strand and all of the nucleotides of the antisense strand comprise a modification;

(c) at least one of the modified nucleotides is selected from the group a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5'-phosphate or 5'-phosphate mimic, a nucleotide comprising vinyl phosphonate, a nucleotide comprising adenosine-glycol nucleic acid (GNA), a nucleotide comprising thymidine-glycol nucleic acid (GNA)S-Isomer, a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate, and a terminal nucleotide linked to a cholesteryl derivative and a dodecanoic acid bisdecylamide group; and combinations thereof;

(d) said modified nucleotide is selected from the group consisting of a 2'-deoxy-2'-fluoro modified nucleotide, a 2'-deoxy-modified nucleotide, 3'-terminal deoxy-thymine nucleotides (dT), a locked nucleotide, an abasic nucleotide, a 2'-amino-modified nucleotide, a 2'-alkyl-modified nucleotide, a morpholino nucleotide, a phosphoramidate, and a non-natural base comprising nucleotide;

(e) said modified nucleotide comprises a short sequence of 3'-terminal deoxy-thymine nucleotides (dT); and/or (f) the modifications on the nucleotides are 2'-O-methyl, GNA, and 2'-fluoro modifications.

9. The dsRNA agent of claim 1, wherein (a) each strand is no more than 30 nucleotides in length;

(b) at least one strand comprises a 3'-overhang of at least 1 nucleotide;

(c) at least one strand comprises a 3'-overhang of at least 2 nucleotides;

(d) the double-stranded region is 15-30 nucleotide pairs in length;

(e) the double-stranded region is 17-23 nucleotide pairs in length;

(f) the double-stranded region is 17-25 nucleotide pairs in length;

(g) the double-stranded region is 23-27 nucleotide pairs in length;

(h) the double-stranded region is 19-21 nucleotide pairs in length;

(i) the double-stranded region is 21-23 nucleotide pairs in length;

(j) each strand has 19-30 nucleotides;

(k) each strand has 19-23 nucleotides;

(l) wherein each strand has 21-23 nucleotides; and/or (m) wherein the sense strand has a total of 21 nucleotides and the antisense strand has a total of 23 nucleotides.

10. The dsRNA agent of claim 4, wherein the 3'-end of the sense strand is protected via an end cap which is a cyclic group having an amine, said cyclic group being selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.

11. The dsRNA agent of claim 4, further comprising (a) a targeting ligand that targets a liver tissue; or (b) a targeting ligand that targets a liver tissue, wherein the targeting ligand is a GalNAc conjugate.

12. The dsRNA agent of claim 1, further comprising (a) a terminal, chiral modification occurring at the first internucleotide linkage at the 3'-end of the antisense strand, having the linkage phosphorus atom in Sp configuration, a terminal, chiral modification occurring at the first internucleotide linkage at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp configuration or Sp configuration;

(b) a terminal, chiral modification occurring at the first and second internucleotide linkages at the 3'-end of the antisense strand, having the linkage phosphorus atom in Sp configuration, a terminal, chiral modification occurring at the first internucleotide linkage at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp or Sp configuration;

(c) a terminal, chiral modification occurring at the first, second and third internucleotide linkages at the 3'-end of the antisense strand, having the linkage phosphorus atom in Sp configuration, a terminal, chiral modification occurring at the first internucleotide linkage at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp or Sp configuration;

(d) a terminal, chiral modification occurring at the first, and second internucleotide linkages at the 3'-end of the antisense strand, having the linkage phosphorus atom in Sp configuration, a terminal, chiral modification occurring at the third internucleotide linkages at the 3'-end of the antisense strand, having the linkage phosphorus atom in Rp configuration, a terminal, chiral modification occurring at the first internucleotide linkage at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp or Sp configuration;

(e) a terminal, chiral modification occurring at the first, and second internucleotide linkages at the 3'-end of the antisense strand, having the linkage phosphorus atom in Sp configuration, a terminal, chiral modification occurring at the first, and second internucleotide linkages at the 5'-end of the antisense strand, having the linkage phosphorus atom in Rp configuration, and a terminal, chiral modification occurring at the first internucleotide linkage at the 5'-end of the sense strand, having the linkage phosphorus atom in either Rp or Sp configuration;

(f) a phosphate or phosphate mimic at the 5'-end of the antisense strand; and/or (g) a phosphate or phosphate mimic at the 5'-end of the antisense strand, wherein the phosphate mimic is a 5'-vinyl phosphonate (VP).

13. An isolated cell containing the dsRNA agent of claim 1.

14. A pharmaceutical composition
(a) for inhibiting expression of a gene encoding ATXN3 comprising the dsRNA agent of claim 1; or
(b) comprising the dsRNA agent of claim 1 and a lipid formulation.

15. A method of inhibiting expression of an ATXN3 gene in a cell, the method comprising:
(a) introducing into the cell the dsRNA agent of claim 1; and
(b) maintaining the cell produced in step (a) for a time sufficient to obtain degradation of the mRNA transcript of the ATXN3 gene, thereby inhibiting expression of the ATXN3 gene in the cell.

16. The method of claim 15, wherein
(a) the cell is within a subject;
(b) the cell is within a subject, wherein the subject is a human;
(c) wherein the expression of ATXN3 is inhibited by at least 50%;
(d) wherein inhibiting expression of ATXN3 decreases an ATXN3 protein level in a CNS biopsy sample or a cerebrospinal fluid (CSF) sample by at least 30%, 40%, 50%, 60%, 70%, 80%, 90%, or 95%;
(e) the cell is within a subject and the subject meets at least one diagnostic criterion for SCA3; and/or

(f) the cell is within a subject and the subject has been diagnosed with SCA3.

17. A method of treating a subject diagnosed with an ATXN3-associated disorder comprising administering to the subject a therapeutically effective amount of the dsRNA agent of claim 1, thereby treating the disorder.

18. The method of claim 17, wherein
(a) treating comprises amelioration of at least one sign or symptom of the disorder;
(b) treating comprises amelioration of at least one sign or symptom of SCA3, wherein at least one sign or symptom of SCA3 comprises ataxia, spasticity, rigidity, bradykinesia, dysarthria, spastic paraplegia, peripheral polyneuropathy, and parkinsonism-like symptoms; and/or
(c) treating comprises prevention of progression of the disorder.

19. A method of delaying development or reducing severity of an ATXN3-associated disorder in a subject having a mutation correlated with an ATXN3-associated disorder comprising administering to the subject a therapeutically effective amount of the dsRNA agent of claim 1, thereby delaying development or reducing severity of an ATXN3-associated disorder in the subject having a mutation correlated with the ATXN3-associated disorder.

20. The method of claim 17, wherein
(a) the subject is human;
(b) the dsRNA agent is administered at a dose of about 0.01 mg/kg to about 50 mg/kg;
(c) the dsRNA agent is administered to the subject intracranially or intrathecally;
(d) the dsRNA agent is administered to the subject intrathecally, intraventricularly, or intracerebrally;
(e) the method further comprises measuring a level of ATXN3 in the subject;
(f) the method further comprises measuring a level of ATXN3 in the subject, wherein measuring the level of ATXN3 in the subject comprises measuring the level of ATXN3 protein in a subject CNS biopsy sample or a cerebrospinal fluid (CSF) sample;
(g) the method further comprises performing a diagnostic assessment selected from Scale for the Assessment and Rating of Ataxia (SARA), Composite Cerebellar Functional Severity Score (CCFS), Spinocerebellar ataxia Functional Index (SCAFI), Inventory of Non-Ataxia Signs (INAS);
(h) the method further comprises administering to the subject an additional agent suitable for treatment of an ATXN3-associated disorder; and/or
(i) the method further comprises administering to the subject an additional agent suitable for treatment of an ATXN3-associated disorder, wherein the additional agent is selected from symptomatic treatments for Parkinsonism-like symptoms (levodopa or dopamine agonists), psychostimulants to improve daytime fatigue (modafinil), mexiletine or carbamazepine for cramps.

* * * * *